United States Patent 7,612,194 (NUCLEIC ACID SEQUENCES FROM DIABROTICA VIRGIFERA VIRGIFERA LECONTE AND USES THEREOF) - sequence listing, part 2

SEQ ID NO: 6178 - DNA, 384 bp, Diabrotica virgifera
  Clone ID: LIB150-025-Q1-E1-C2
gcgggtcgccacacacgtctcgaaagttgctcgtaatattgttatatctgagttcaacattcactcagagatatgatgtggacagcgattctgattatacatcataggagtcttcccctgacgctgtgaactattttgcttaatcttcaaggactgcatcactagctgggtgcgaactttgggatcacgaatgttgagttaatctcaattcatgaacgtcattaattgattaacaattgatgcctacttgtaactcatgattagagtatgtcacacaaaagtccttagaaatatcattagcggtacgctatggtctagtctgtgcatactttttcaatgtgtgaaattgatcaatgatgtatggttgaccaaacatcatatgga

SEQ ID NO: 6179 - DNA, 370 bp, Diabrotica virgifera
  Clone ID: LIB150-025-Q1-E1-C5
acaactccctgaggtgagtcgtattataatttcagattgatcaaattcatcgttttcgttgccattgcattcttggttatccaggctgttgaatccaaaccaagggcttcccatgagcaacgcccatctgcccataatgtagcagaagacgagctctcgtaagaaggctcacgatttgatcataattgccgatgaagtcgttactggttacctccccagcaccagaccagatcatcaacattgtaaatgaaaccggcataatattggttagcatcatgaaagatttcatcgaccaccttaagacccaactcactgcatacagaggtgatgtagacataattttgagacatgtatctgacactttgcacgc

SEQ ID NO: 6180 - DNA, 389 bp, Diabrotica virgifera
  Clone ID: LIB150-025-Q1-E1-C6
acaacaccctgacgtgagtcgtattaaagatggactgatcgtggatcttttcacctaacatctacagtgtgttgttttcgagtaaaattccttcagtttgtggtgagcacttcaccatataaatgatgaacgagtcaagaatagacatcctcaatgaaagcgaatatgaaaatgatcaatttgcaagtgttccagcaattgaaggccaattcccatgatcccacaatggcttaagctactaccacctgtgcattacaatactcaaactcttcgtagtccttgcagtattaatcattaacatacttctagtcattgtaattctcagagttagaagacttcatgcgataagatccaatatctacattccgaataagattaacatgaatacc

SEQ ID NO: 6181 - DNA, 376 bp, Diabrotica virgifera
  Clone ID: LIB150-025-Q1-E1-C8
tgagtcgtattaaagcgtccgatttagaaaaatgtctctagctgaggaattgcttgctgatcttgaagacaacgatgcagatgacgtcgaagaagagatggaagaaattcccgaggaggaagttaaagaagaaaagccagatttagaagacttgttgatggaacaagaaagtgtacatataaattcagtcagagaaatttgcaaacttagggattctgaaacattacaacatttaatggagcagatacaagggtttggcacaaagattcggaaatctgtagatatagtacgtcccgttgaaacagatcccgaatatcagttgatagttgaagctaataatgtagcccacgatattgaataacggaataaaacagtg

SEQ ID NO: 6182 - DNA, 418 bp, Diabrotica virgifera
  Clone ID: LIB150-025-Q1-E1-C9
cgcgggccgacgcaagagtctatatggagtcatgcaagggttctccgtgcttcataaacctacccaaactgatacaactatacatagttcatcattctacacaacatagattagcatagcaatctatcacagcatgttacatacagtaacagaaattaccatgtcaaaaaaataacttcacgatagaaatgaatatcattaagcaagtagtagtaaataataggtacaacgaacaaacaataaacaaaattttaaaccaaaaactgcataacaaatccttgagattagttgaaaagaataaagaccgcgtcccgccatcaaataatttgatcaaactggtttgagcaaactgaaagtgacagttagtgacgtcacatcctgagtgttcattgtggataataatgaaaaattttaattt

SEQ ID NO: 6183 - DNA, 336 bp, Diabrotica virgifera
  Clone ID: LIB150-025-Q1-E1-D10
ttgcaacaccctatagtgagtcgtaatacctcctacggtagactaagtttagacacaacttctgtgaatggagctctgaaacgtgagaccgtcgcgagtttttgcctctctgaaacggaaatatgctagtgagcaaagttgcacgtactaacatgtagacgtcgcatagcgtgtccacagagtcccgatatacaccagaatggcggttcaagcgttactgcaattcagtgtgagtcaaacgttcagtttcaagttagagacaacgcgcacattgtgttgtgtataagatattaaacaacttggaaaagaggatttcgaatggagactccggactgt

SEQ ID NO: 6184 - DNA, 396 bp, Diabrotica virgifera
  Clone ID: LIB150-025-Q1-E1-D11
tatactgattcatatgagagcacatcggactattttgttttacagtttgtcacaatctggtggaataactattgattggcaaacgttacagagatagccgttgtcaccatattttgctagatgttcttgatttatgagttttatatgtaatttgtgtgacagggggaggtagaataagaacgagactgccttatcagaagtattaaaagcagcaatattgaaataaaggttgggatatttagaaagatgaaggaatcacaattataataaaattggagagaacaactaacactgtgattaaccccagatgatatgacatattccttgtttgtctgtaattatgtcaatgtttcagattgcatagtagagataccagtttataaatttggaaagctt

SEQ ID NO: 6185 - DNA, 401 bp, Diabrotica virgifera
  Clone ID: LIB150-025-Q1-E1-D12
gggacgatacaagactctatagtgattcgtataaatttatatttatgttttgtttgatatttaccgacaacagtcaaaaagctgaagattttaataaatatctggcctgtgaattaaagtgttattttgatagtttaatacataagaagtgttcttattttattactataatattcatcaaacatcattaatgttgctgcagaaagaccgacttgatgaatctttcaactccttcattgaagaagataaaagatatagacttctattgatgatgacatcaatgctattaacaataatggtggtgttagtttattgttttgacgttgtgctaccgatcaccactgaagatcccattcaaatgttgtatatcgaaaatgataaaccttccacatttaaaacca

SEQ ID NO: 6186 - DNA, 434 bp, Diabrotica virgifera
  Clone ID: LIB150-025-Q1-E1-D4
ggggccccacacgcgtccggaaactgactctgacacagatataagtatgcaataccaaaatcttagtatatatgacaatggtccaccatttgaagtctttcaaaatgaagaaacaactaaaagccccaatatcgatgagaaagccttacggatgatgcaaaaaatgggctacaaagaaggatctggtttaggtaaaagtgaacaaggaattactaaaattatagatataaactatcaacatggtaaaagaggtttgggactaaaattaaaacgtattgaagatacactcaaaacgtggaatttctcaattgaggaggtgaacataaaggaaaatttgatttggctaaaaaatgaagcagcttcagattatacagaggaagaactgttaacgtggataaaagaacgagagcatgttacggatattaaaacccaaa

SEQ ID NO: 6187 - DNA, 422 bp, Diabrotica virgifera
  Clone ID: LIB150-025-Q1-E1-D6
actcgcgggtcgatacacgcgtctaaacagacgcctgataaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaac

SEQ ID NO: 6188 - DNA, 260 bp, Diabrotica virgifera
  Clone ID: LIB150-025-Q1-E1-D7
tgagtcgtattaaaatccgtcaacatgtaacgatcttatcatgttacggtcactgagaccagcccaggagattcagtggtattgatgtcttatagagattacctgtgggatagcgcgttcgcgatttcgcagtaatcgagactggcgaagttcgtttgacctcctataggtgctatctgtgcagtatcgcagaaccgacgagactctgacgtctgttataggtatgtcgtggtgcatcagggaagcgcagatctttgtgt

SEQ ID NO: 6189 - DNA, 410 bp, Diabrotica virgifera
  Clone ID: LIB150-025-Q1-E1-D8
ggcggacgcatccaaggcacagaagctgaagttggcagattcaaggaaaaggaacatgagcaatctaccttacattatcagcaatacacagaagagctgaacacacaacttctaaccatccaagaacagtaccaacatatacaacaagaaaatgacaaattgtctgcagaggtacatgatagagtacaccatatctgtgatcttgaacggcaactccagaacaagcaaaatgaaaaggttacatttacctccagcaacggaacgggtttgaatgtcaaggaagaactggaagtgacgaaagaattgtgtgtccagctacaggttagattgaactatttttcttgcaaatattttaaatagttttaaatctttgcattaccaaatctgcaaaatcaagctaaataccttta

SEQ ID NO: 6190 - DNA, 189 bp, Diabrotica virgifera
  Clone ID: LIB150-025-Q1-E1-E10
gtgagtcgtattacctgttaaagctcctcatcacggaacgacattctgtcgctgagtgtatcatcaggtgtgaagatttcagcaccggtcatatagaatagggatgtttttcgcaatgaaacggaatgatgaattatagtcagcctgaattttcttaaacatcaaggataaagagaatcttatcgcaag

SEQ ID NO: 6191 - DNA, 411 bp, Diabrotica virgifera
  Clone ID: LIB150-025-Q1-E1-E11
cgacgataaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactataaccaagctgatattcttactgatattttccgtcagtatgaaggtactcttgacgacaccaaatactacagccttcttaacagaatccaaatgttagttgaagctggactcattaatgaaaccatct

SEQ ID NO: 6192 - DNA, 394 bp, Diabrotica virgifera
  Clone ID: LIB150-025-Q1-E1-E12
tcccaaactctatcgtgagtcgtattataaatatcgcatcatgagtttcatcggttcaagcatcctcttggcgctagccctacgtttgaccaacgctggttactaacatggacatcaagacctaggcagccatgatttaggaggcggccatgatctcggaggcggtcatgaactcggaggacaagattacagcggttatgggggtggtcacggcggctggcaaccataagttcaagaacaccaccaacacataccatctaataccattgagcatacccaagcggttgcagtacctgtagttaagaaagtaggagtaccagttccacatccagtacgagtaccagtaccacaggtcgtaaaagttccagtacctcaaccttaagccgtacatgtg

SEQ ID NO: 6193 - DNA, 384 bp, Diabrotica virgifera
  Clone ID: LIB150-025-Q1-E1-E4
gtttacacaattcaacagggtttgaatgttttctacactgccgttatggaggagtcatctgcgtatctgaagttattaataatttcaccaccgattttaacaccttcacgacggttattttaacgctgtctcaaaaactggtttagagtaggcattaaacaacataataattgagaagtaatttgtccaagtttgcatataattgtcaaaaacaatgacaaaaaatatgtatgacaacatatttctgttcagttaaatttattattttttcgacaaagtgtttttttattactgtgaatagaccaaatgtgtcgtaaataatatacaagaattaacaaaaaagcgctgattatttataaatctgaacagttaaatgaggagctc

SEQ ID NO: 6194 - DNA, 399 bp, Diabrotica virgifera
  Clone ID: LIB150-025-Q1-E1-E5
actcgcgggtcgatacacgcctctaaacacacgtctgctaaaatattagtatttgagttagtttcaagcggtttctgcaaaataatttgagtcacctctcaacgtccatctcaatacagatgcgctctggactataaaggaactggaatttttcgttacgcatgatgtgacctatgccgtattcctttacttgatggatcctatatgttgggaatcatggatgattattttgaggacaactacatttgtgactttcgccgtcaatagataccatctttaagagacgacgatatagccacatttcgaatgctgcaaagttgtgtaaatccctcgtttagagtgctcattccttctacgcgatatatcagcatcgatcatacgtagcacttagtaagtctc

SEQ ID NO: 6195 - DNA, 398 bp, Diabrotica virgifera
  Clone ID: LIB150-025-Q1-E1-E6
gcgcgggtcgatacaagtctctaaagagacgtcgtgactaacgcgtcagcacacgcgtcggctcaggcgtctgaagaatggcattttatggatgagtctcaagcgtcaccaaaattcatgttcaatttttcacagtactttttcttcacacgagagtcaagcatttcctgattcggagactggtttacactccgaaagtagctttggtgtaactgatgagtaagtttgccaagttcgcataaatctgacagtcgtaatgtgtatactgctgtatggtcacagaactgtgcgaaatatgtgatgcacattagaccgcatactgtttggatagtacagatgacagagaagatgttcagaaaattttgggggatcttatcggagccactactgagtagata

SEQ ID NO: 6196 - DNA, 427 bp, Diabrotica virgifera
  Clone ID: LIB150-025-Q1-E1-E8
aaaacacgcgtctgcccacgcgtccgctataacgccgcgaaatagttggtatttcagttagcgatataatttaaacgaaaagtctataaataactacaacagtatacttagtttttttcacaacgtaaatgtacattctctgatttgttaatacatagttctttttgcatttgacattaaaaataacttaagtgagtgtgtgaactttactaccatattcttttgctgatattaaaatggaaatctgtcatataaaatatctttattttaaaaatattatactcagtttgtataaatactcactctttaagattttttagaacatttgctaacttctaaaaaatactgtccgaagaaaatttcagaattacttactaaatttgtttaccaaatgtggcaacggtatttttccaaaaacgacgaaata

SEQ ID NO: 6197 - DNA, 401 bp, Diabrotica virgifera
  Clone ID: LIB150-025-Q1-E1-E9
atccacgcatctggtgatatgaatctagtcgaagaagaatccaagggagcaaagccatctcgacctcctccaaaacccctgatagaaaccgctataggacaatggaccatattatcagttgtcttaggtgctgttgcagttctaacagttattgccataagtgcagatgagtgtaggaaatgcttcgataaagcatcaaacttgcaaccgctagagaaaatacacaaggcgtattgggcatatggaaaagatgtcgacggagggcatttgaaagaagttttcacgatactagatcgattaggatacaagaaagacgataattactcagagtgggatctgctttgggcccacgattatccctttacggaacttaggtcgcaattagacaatcttgaaactca

SEQ ID NO: 6198 - DNA, 249 bp, Diabrotica virgifera
  Clone ID: LIB150-025-Q1-E1-F1
cgggtcgccacacgcgtctgtaaagggtcccgttattgcgtccgcttttttcagatgtacgttcgaatgtgcatgatcgaaaccttacattggcggaagatctagtaatgtccgtatatcaggtatcgttcgtgtagtaggactcgctgttacatagagtagtcggaatatgaatccttacgagatattgtgcttgggacgaaggtcgaggatatggtagacagttgagtgcacattctgttacatggt

SEQ ID NO: 6199 - DNA, 343 bp, Diabrotica virgifera
  Clone ID: LIB150-025-Q1-E1-F10
cctatagtgtatcgtaatacgtatcacatattgagaattttaaaggagagactttattgtgtggtgtttgcctatgtcttatgaataaaatatcattcgtttaccgaaattgccgtgattattgataatacttgcgcatggaggaattgtcaggcagtagcttttaccgtctaccactagatgaagccactaatacaattttcgcataaaatggacttggcatgttgcgatttagaccgacgatttgtcacgttacttcctgataagcgaaacttcagtttaatgtgattacctcaatttccataactttcatatagttcaatcatcgtataatcagtaaaca

SEQ ID NO: 6200 - DNA, 367 bp, Diabrotica virgifera
  Clone ID: LIB150-025-Q1-E1-F11
agaataattacaaagatattattttcaaatttaatcgtgcgcaataaatggtatttttaatgatacctaaagatatcaagtcgtttttatagtaagtgtatgtaaatcgtctttatgtatctcaaattgtttctgaaataaactactattaggtagcattataatatgtagatattatatatttctagattattcatatgcaataattttacggatgatctgaaatgtcatctatcattaaaattaagtttttaaaggactgattaagataaagatctttcatacacaaatcataggttattatttaattctataaattattatttgtactttttataggttttttattacaagagataattaaatt

SEQ ID NO: 6201 - DNA, 383 bp, Diabrotica virgifera
  Clone ID: LIB150-025-Q1-E1-F12
acaaacaaacaatcataaacaatgacgcgctggtacattgatttttgtccgtttcagaactctttcataaccaaaaaggacgatatgtacttcaagatgaagaaactaagggatatggagtgtgtaaaaatgaaggaagcctctagtgccttgtggatgatcaaaaacagtgccaatagcagctgggtggaggagttattagcggagagtatccttctcgaaacacagctaaggtacaaacttatagttaacaaaatccgagaaagcaaagacatggatataccactcaaaacaaggaaacttacaggatcggtcgcgttatcaaatctacagtacgacataagagaacaagacaagaaaacaagcgattccacaacatttta

SEQ ID NO: 6202 - DNA, 398 bp, Diabrotica virgifera
  Clone ID: LIB150-025-Q1-E1-F4
acaagcccccaaaaggagtcctattaaataatggcaaatggaacaacctgattatttgtgcaatcttggctgtagcttttgcagctccacaaagagtggacgaagatgatggccaatatcaccctgaaaacagtggacaatatgccgctgatggtgctggagcatatagaggtgttccaacttcagccttgggttctctagtttctcaataccgccctcaaccaaaagcagtaaattattatccaggtgtaccaacccaatataacaatggccaaaatggtcagtacagatctgacagtcaagatgatggtcaatatcacccagatcattccggagattacaatggagatggttcaggagcatacagtggtgacaattccggtgcttacagtggtatc

SEQ ID NO: 6203 - DNA, 273 bp, Diabrotica virgifera
  Clone ID: LIB150-025-Q1-E1-F5
tgagtcgtattaaaaaaaaaaaaaaaaaaaaaaaaaaaaaaagaggtcagtagacaaatacaagttcaaaatacaacaacctgacagcgtggcaagatcacgcaaccaatgggggtcccagttccagttgaacggcctgtggctgttccgagatcgtatgctgctgtcctggcgcttccaatatttgtcaccgtgcagcatctagtacatttaccagcacgagaaaccattgctgtgccagcgctacatccccatccagccagtgtcccagtc

SEQ ID NO: 6204 - DNA, 380 bp, Diabrotica virgifera
  Clone ID: LIB150-025-Q1-E1-F9
tacagtgaatcgctgcctatcaagatgctccgcgtacaatctcaggaagttagcacccaagaatattcagtggagacgacgacatatgaaacatacggatatgataccactttctctgtctcggagacatcgaagctagatcatttcgttttacctcctagaactacgatcttagcattgtctcagagcggcggagataatgaagaagacaaaaagtatgtcgtcaccaatcacggaaaagctgatctttttgttgaggtagtacacctcaataaccaagatgatgctccacaatggtttgtggtccagccagaccaagccagtgagattgctattgaggacaagcttgaacaaagtgtgttgaaagtgaacaacaacag

SEQ ID NO: 6205 - DNA, 196 bp, Diabrotica virgifera
  Clone ID: LIB150-025-Q1-E1-G11
aacagtctgatctaacctcgcttgggcattcgcagtcccaccatctaatccttactgcttttggccccatctcggcgacgctccgtgctcctggtggtgggtgatggagactggtgcttcccggtggggtatcacagtcggttaatgtgcggtcgattttggcgagtcaggtagtgtgtggtagtgatttcagatg

SEQ ID NO: 6206 - DNA, 399 bp, Diabrotica virgifera
  Clone ID: LIB150-025-Q1-E1-G2
gggtcgctacacgcgtctgtacagtggccttagcaattgtcacccttgccgtcgtggcccaagcagaaaaggccaaggacaaacgtttggcagtggatcccaacaccggataccatcaaggtgcctctgcgtactcccatcaatcttctcaaccacaatacgtctcagcccaaccacaacagcagcactactaccaacctgaggccgttcaacaacaagccatttcatatactcaacctattagcaagtacgcttctgctggtgcagctccagtacaaaagtacactttcgcaccacaacccgctaaacagcaagtacaatactcctcagcagctgatgtgtccagcttcagttacagcagccctatcgtatcttacaacaacttaggccttttgaaac

SEQ ID NO: 6207 - DNA, 392 bp, Diabrotica virgifera
  Clone ID: LIB150-025-Q1-E1-G6
aaaacacgcgtccggtccttaccaagaataacatctaaaatgaaatacatctactttttgttcatttatttcttggttgccttagcaaaggcagaagaaactgttagcttagaaggaaaactcccaaaatgtgagtgtagggatataatcgatgagatcttgtgcaagctaacagaaaactcagaaaaggtcctcaaaattcaagccaaactagccaaagtagtgaaagaaaccaatgaaattctaacagaagctaaagaaaactcagcccaagtgaaagaaatcgtctctgttagcaccttgcttaaatctcaagtcaactctacggtcacagtcgttactgccaataccgcagctatcattcaaattaaaaatcaagtccacgaccatgt

SEQ ID NO: 6208 - DNA, 473 bp, Diabrotica virgifera
  Clone ID: LIB150-025-Q1-E1-G7
tcgcgggtccatacaagcctctaaacacacttctgttatagtcttgggtgtgtaagacaactacagtgctgcctttatctgctttagtgactgtaaggttattttcactaattttcttatcaattgatttaatggtgtccttatattcattgagagggtttctgtgatagccctttctgttgttacaaatagcctccttttcttttttcagtaatactttcaaactgctcctaatttcttctgtgttttccagtggtattgattgtaagatactttcactctcaactccaagtagttctagatttctaagttgttgttttttagaagattgggggggattgaatttgaaacctttttggagtagagacagttcattatttgaaaatactacgttagagtaatttatgaaaggggtatagaatgtatgttgctcagagccatcgaaaatgttgtctgggtcagaagatatatat

SEQ ID NO: 6209 - DNA, 76 bp, Diabrotica virgifera
  Clone ID: LIB150-025-Q1-E1-H12
acaacaccctatagcgcgacatagaatcgtattagactcactaactggagtcgtggaatcgtattctactcaatga

SEQ ID NO: 6210 - DNA, 67 bp, Diabrotica virgifera
  Clone ID: LIB150-025-Q1-E1-H2
cgtgggtgaaaacttgggatggaatataaaggtacttgctatttaatagggcctacattttgacaca

SEQ ID NO: 6211 - DNA, 320 bp, Diabrotica virgifera
  Clone ID: LIB150-025-Q1-E1-H5
gcgtgggccgacacacgcctctacagagactcctaataacgcgtgagatgtctcgtgggttgacgcttgggcgcgccaggtgtttcatcttatttatggtacctttaaatctaagtttattttcttgtagttgaatgttattcatttctaaatataccgaatttgtaaggaaaagattcaaaatatcattattgacattagatatgtacattcagatgtttactatcaacaactggtaaataattttagggatgtgctgatagctacaattgtactagcatttaattctgaaataaaggctacgaattgggtttttgatc

SEQ ID NO: 6212 - DNA, 449 bp, Diabrotica virgifera
  Clone ID: LIB150-025-Q1-E1-H7
tgaagaatcaaatttctctgagaacaggcaagatttgcaggtacgatagaggtttctgttatgatccaactgataccaacacttatgctgtcgtttgggaaatcctcgacaagtccaaagttcaatgtcctaatcaactctttaaggtattccaaggagatgttgatttctgggaattcaagcaacaaggtctcaactatttgttccattacgatgcgcttgaggacaaagctttttacttgagcttagagaacagagcccaatgtcaagatacagatgtttggtacaccgaagaaggttacattgtgtccactaagccacttaaatctaaagatatggaatccaaaggattggctctgagaaccaaaggaggagttaaaggacgtgttaagggaagagccataaaagcaggagctagcgtaagtcacgattacctcactgtcagaacc

SEQ ID NO: 6213 - DNA, 407 bp, Diabrotica virgifera
  Clone ID: LIB150-025-Q1-E1-H9
tccaggcgatccgggtaacagacacagcttggaaggaaagcctgacgagattgagaagcagagttagattagcgcgtaagcgttaccagcgatgtggaatctatctcgaaaggcagagacttctgcaagaatacagagacataaaaagtgaatataaaagggaaatagtgcagaccaaggcgaagagctgggagatgttcgtatcgagaaatctggaactggacatgtggggtgtcccatacaaaatcgtatctaacaaaataaaaagcccaataatgctttcaactttattgaaggaagacggctcgttgacagagagttgggaggaatcagctgacatattgttagatgtgttgctgccacccgatgacctagaaaacgagaccgaaatacaaactcagatcaga

SEQ ID NO: 6214 - DNA, 370 bp, Diabrotica virgifera
  Clone ID: LIB150-026-Q1-E1-A1
cctaaagtgagtcgtattacgtcatcaagatgacatgatcgcaacacgttaccgtcacgaaaaccactacgacatatgaggaatacgagtatgaaaccactttctccgtttcgaagttatcgaaacttgagaatttcgttttacctcctagaagtacgatcttagcagtgtctcagagcggaggacataaggaagaatacagcaagtatgtcgtcacgaatcacggaaaagctgatctttttgttgaggtgatacatctcaataactaagatgatgctccacaatgggttgtagtccaaccagatcataccagtgagatagatattgaggacaatcttgaacaaagcgtgttgaaagtgagcaacaacag

SEQ ID NO: 6215 - DNA, 157 bp, Diabrotica virgifera
  Clone ID: LIB150-026-Q1-E1-A12
agtcgtattaaaaaatacgactcactataaggagtcgtattaagttgtacgactcactagtggggcgcgtgataagttgtattaagctataatgagtctaattatctcggtcgagaagtttgagaagtttgttgggggagttgagcaccttttaagt

SEQ ID NO: 6216 - DNA, 431 bp, Diabrotica virgifera
  Clone ID: LIB150-026-Q1-E1-A2
ccaccccccaaaaatgattcgtataattggaaaccaccatggaagaacttcttgactcagatgaaaaagacactgaaatgaccgttttggaaaactttcctttaagcccaagaactgctgtcactgttttgagtcaaaatgttgaaggaagcaatgaacatcctggaaagtacactgtaactaaccttggaaaagctgctttcgatattgagttgaagcgtacctcacccgttcaaactctagagctccatcgcaaaaccgttcagcctaatacatctgagtcttttgaactcacagctcagttccaatctaccgttttggaagttatcaacacaagccagactgaagatgcagtctttagagctgaaggaagagatgttattgaagatcttgaagatttagttagaaatattgatgagaaagcagaaact

SEQ ID NO: 6217 - DNA, 401 bp, Diabrotica virgifera
  Clone ID: LIB150-026-Q1-E1-A4
aacactctaaagtgagtcgtattaatgccgctgagaattgattcaagagctgacgatgtcgataaacatgaacatgatattaactgtttattgtttaatgaggggaagttgtatagtggagctgatgatggaactatcaaatgctggttgccagatctgactaaaaaatcagagataaaagccaattcatgttcggtatacagcttggcaggcgataacaattgtatttactcatgttcaaacgaaggaagtgtcgattcttatgctttggatacattggaaaagaagtcagtcctgctccacaattccgaagtagaataatggaaagttcgatcagttaatggagtgttgtagtctggagataacgaacgatttgtcaaagtatggaaaaatggaacact

SEQ ID NO: 6218 - DNA, 428 bp, Diabrotica virgifera
  Clone ID: LIB150-026-Q1-E1-A7
agcctctatataaagtcagtcttaatataattggttaaaatgttcataacctcacaactttctcacatttctgtggtctgatcttatttttccttctccctttgtagtgctttggtgcttaactgttaaattttctcggtattgttatatagtgtagaggcatgtacgctgacaatcaatgcaagaataaatcgaaggcatttgacacataggtatcttaaaataataaagtagctatccaggaaagactccaaatgatgaacaaacgaaaagagttgttaattaaaactgcagtatctgtactaaaattgccctgaagttagctaacatttatcgcgaagatgacacttgaagaaaatgaaggttttctgcaatagcctctttagtgcactaatcaatctctataataataactcatgtctgttttt

SEQ ID NO: 6219 - DNA, 181 bp, Diabrotica virgifera
  Clone ID: LIB150-026-Q1-E1-A9
atagtgagtcgtattagatagctccggtaagacgtgtgacgtgttagcagcgcttaggctcggtatagtagtccatttttcatttacccgaacacaggcagttctagtggagaacgggggaaatttttcgagggaagtcgcagcaccggatcaagttggatcacgtgatgctccctccgaa

SEQ ID NO: 6220 - DNA, 344 bp, Diabrotica virgifera
  Clone ID: LIB150-026-Q1-E1-B11
tgtactcattcttcattccgttgttgccttgagcagctgcttaccagcatccagaaatcaacactacgttgatgtacactacaacagctacaaggctcatcccgtctacaacttctggatgacttggaatcagcaacactatggacaagaaccatggaaccaatgggtacaatatggtgtccagaaccaatccggtaactactggagggagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaac

SEQ ID NO: 6221 - DNA, 213 bp, Diabrotica virgifera
  Clone ID: LIB150-026-Q1-E1-B12
ttcatggttcaccacttcacatgagaggctaagcaactacgatgcagcatacaaaccgtgtcaacggctgaatagactgctgcagcaggcacaagcccaattcagaaacgattgtgcggattataccatggatgcaatcaatggtttagactcaggtgacatagttgcgactccattttggggatcccagactggttcaaaagtgacctggat

SEQ ID NO: 6222 - DNA, 356 bp, Diabrotica virgifera
  unsure (1)..(356): unsure at all n locations
  Clone ID: LIB150-026-Q1-E1-B3
tccctgaatgccccctgggggaaaaacaaaggggcaatttcgcccgcncccgcctgcggggctgaactttccgcaaaccgcccgccaatccnnctgggaagggcagttactttaaggggaaacgcacnngctctaacgtttcgccccttttcccccgcaaagttactttccccgaagggaatttctcgcgaggcgttttcgtcgcgccctgctcgaaggccggccgaagggagcaaaacttaaatgcgaagcaaatgtcgttgtgngtaattccgcncgccgaatcgaaccgnngacagagccgttattaaagtccgaacttttaatgttcttgngggctttgcggtattgtctcc

SEQ ID NO: 6223 - DNA, 354 bp, Diabrotica virgifera
  Clone ID: LIB150-026-Q1-E1-C10
gtcattgcaccaccctaaagtgaatcgtattacatcttaacatggctcagattgattttgaagtggttgattagtcaattactttttcgtaaaaagcagttcagaatggcatcagccaagtactcgatttttacgaatcggaatatgcttagtagccgttatgcagtggagagcattaatgaaaagagcagtacgaaagaattgcacgtaaatgggagatcaagtgttattgtttacttcctttaagaacagtagcaacatgttgggggtatataaccgatgtaacactagccgacgtactgacgcctcccgtttacaaaatgtactcaaacgcattcggtgttaacatcgcat

SEQ ID NO: 6224 - DNA, 364 bp, Diabrotica virgifera
  Clone ID: LIB150-026-Q1-E1-C12
atagtgagtcgtattaaagcgtgggttcgactggccctgtacctctagtgtatttgcaaattgctaacggctcttggcacttcgtcgttggatggttcggcaatccttagatctgcaaccgctgttctgtctgacatggtcggactgatcttcatcatcactgtttagtaccgtttcgaaatacattttccattctttcacatcttttcccggctcagataatagcactccatctcgggtcattatgtagctagtagtgctttggtaaccatattcaactttatttaccacttaataaaatgatgtgatttcattgtttttataactttcttcaaactcctgcatcattttttcattggatgct

SEQ ID NO: 6225 - DNA, 443 bp, Diabrotica virgifera
  Clone ID: LIB150-026-Q1-E1-C3
ctactccccaaaattaatcctaatagatggccaccaccaaccccaaaaccaccacaaccaaccccaacaccacaacaaccaacctcaaacaaacagcaaccaatccaaggccaacaaacagccaacaatcaaaggtcaaacaacagcaccatccagctcaacaaaatagacctcaagttggacaatgtagaccaatgcgcagaccaagagtggttatgcgtcacgctatgctacgtaaacccattgttcatgatagatacaccgttgttaatcatggaactcatgcttttaccgctcagatcgttcatattaatggaagaaaccaagacgtggtccgcactcaagtcgtccaacccaacgaaacccaagtgcttttacttgaaggcttaaatggatcatctttgaaaatcgtcaacgaaaacgagactgactacgctatcctc

SEQ ID NO: 6226 - DNA, 380 bp, Diabrotica virgifera
  Clone ID: LIB150-026-Q1-E1-C6
actcaacaatgaactcgacaatctggcagaattcgagtcgaaggcggaagtcgcttcccacatactcgagaatctggagaatcttatggatctagatgaactgatcaaagatgaacccttccttctcgatgaaaaaatactaccaatcctggacgaagtggaacctccgcgtgccattccagtacctgttcaaaacttgaagaatgagtttgtcaactccaatgacacccaatatttcctcaaggaattccagaacgtgtacgaagtcgtggaattctcccatggcacgctcactccacctcagtctcccccgagccaaccaatgctcaccaatctcgagccacgtcgacagtatccagtggaaaccaagcatgtttacg

SEQ ID NO: 6227 - DNA, 179 bp, Diabrotica virgifera
  Clone ID: LIB150-026-Q1-E1-C8
agtcgtattaagaacttctgcaaccccagaaccaagaaatggtccaaacaaaaggatgatgagaacagacgttcattccgtacgtacatctagcggtccaatccagaggatttgaggcgccatcatgagctagaggcgggaagaacatgaagcactccgtgccggattgggtattgcct

SEQ ID NO: 6228 - DNA, 393 bp, Diabrotica virgifera
  Clone ID: LIB150-026-Q1-E1-D10
acaacactcaatcgtgatacctcgtacggtagacaaagtttcgacacaacctctgggaatggacctctacaacttgacaaagtagctatattatgccacgctgatacggattcagacgacagtacaaagtgtcgcgtactaaatggtgactgacgcataaattttttcggcagacttgatatgcaacagaatggttgtccaaacattacagagttacagtgagcctcacctgttcaatttcgcgagtcgccaatgacgacaatatgtagtcataaaatgttgtgcgtcattgaaataatgaagacaatggagacacaggatagtttagtcaaggatcagtcgcgcggtatgaaaagatctagcattttaaccatttcagtgataacttttttt

SEQ ID NO: 6229 - DNA, 396 bp, Diabrotica virgifera
  Clone ID: LIB150-026-Q1-E1-D11
gtgagtcgtattatgcaactactttcagaaacatcttagtatctcattttaaacattaattgacttacactgattggcttcttagacattgatttattaacacaatttatttgaccgcgttataaaaatcgataccgtttatcgtaaactaacccatacaaacagttttgcttcttttaaatagtaaaataatacttctctaatattcaatctaattctggttaagaaaatcatatccaaaaaaatatttacacagacaggtaacaaatcatcgtatataaaaaaggtatgtttacagcattccaattataataaataggccgggatcttcagccgtataggagcgctgattgcgtcacagtattatataatcctttcaaactatactcaaatgac

SEQ ID NO: 6230 - DNA, 66 bp, Diabrotica virgifera
  unsure (1)..(66): unsure at all n locations
  Clone ID: LIB150-026-Q1-E1-D12
atagtgagtcgtattaaacnatacgactcactataaggagtcgtattaaaattgtacgactcacta

SEQ ID NO: 6231 - DNA, 436 bp, Diabrotica virgifera
  Clone ID: LIB150-026-Q1-E1-D2
gagtcgtattagaatcgttaagtaaagagttagtttccagcttaaacctgagtgtgcgcgccagattttttaacaccatgtctcatctcatagaggagtttaaaccatgacctctggatttctatcgtaagaaaacgtcttttgactggaaaaagttgaaggtgttccttgaaactgaagatggaatcgagtatcagaatgaaatgtacaaaatgctggaaagtaatcctgtgcacaataaggaaaacctcactagcctacctagagatgaacagcgcagactagcatttttaggatcatgtgatcaagcccaaaacgatattctgagatgggcttacttgctgcaaaacttacgaagaccttcatcccttgctagggtgttaacatcatcggtagcatcagcctacgtaaagcacacggtccgtaacaatttgtt

SEQ ID NO: 6232 - DNA, 113 bp, Diabrotica virgifera
  unsure (1)..(113): unsure at all n locations
  Clone ID: LIB150-026-Q1-E1-D8
atagtgagtcgtattaaacantgcgacncaagctgggagagttcacaggaaaggagcttgagcagacgagcatccgttattattcagggacgagcggaactggtcacatttta

SEQ ID NO: 6233 - DNA, 362 bp, Diabrotica virgifera
  Clone ID: LIB150-026-Q1-E1-D9
cctatagtgaatcgtattactcattatgtcacatacaaattcacaatgaagtttctcgtactttttgccttagtactctactgctctacacaagttttaggaggtccttgtgatcgtgtagagtgcagtcctccagactgtggacttggtgctcgtccagtagtgaaaccaggtgattgttgcgccacttgccaaggattctgtaacccaagatgtgaaggtatacaatgcggtgtaccaaactgccctcctggatctagattgaagctcaaagatggtgcatgttgtccctcacgtgagccattctgtaatccactgtcacattaaggatacagattgttgtgcattctaccaatcacttg

SEQ ID NO: 6234 - DNA, 363 bp, Diabrotica virgifera
  unsure (1)..(363): unsure at all n locations
  Clone ID: LIB150-026-Q1-E1-E1
aaaaaccttcattataagtggtaaatatagctaccatgtacacttaaagggttaatgagacagatgctgtanggttaatgagacaaggaaatttgagagtaggtaaaaacaaaataagaacactgtgtgatttctgttatagacgttggcggaaggatcatacaatagtaggagagagagaaggaggcaagtcgtatatcgagacaggtctgtgctaacctgcgtctatagcttcaaattaagatatatttttcagcaaatattgacaaatacactaacggtgttcgttttcatagtttttaaatcacataataatggacaaaactgttaacttcttgacgagccgatattttagaactggta

SEQ ID NO: 6235 - DNA, 372 bp, Diabrotica virgifera
  Clone ID: LIB150-026-Q1-E1-E11
aacgtcgtaactcatcctactggagtcgcattcagcgttgcacgaccatcacgtcttagtggacacgctctgagtcgcagaggatcgcactgcatagtcgcgccgtgtcgaaaggctactcgctgatcatctgctagattgttgttgatcccatccaattcgagtttattcacaagactggttccacattaggcgagatgtaccaaattagggaatcacgtatggactatgaaagggattatacggtatacccggttggctttcaacgtaagagacgccaagacatggtgccacacttacagatatcttccgtcagtaatcaggcacccctgacgtaaccacattctacaaccttcttaacatcatctagat

SEQ ID NO: 6236 - DNA, 52 bp, Diabrotica virgifera
  Clone ID: LIB150-026-Q1-E1-E12
tatagtgagtcgtactaaaaattacgactcactatatggagtcgtattaatt

SEQ ID NO: 6237 - DNA, 383 bp, Diabrotica virgifera
  Clone ID: LIB150-026-Q1-E1-E4
caacaccccaaaattaattcttataagcatgtcagtgaatacttcagatttgacttaccattctatgccaacttaactcagctggaggacgaaaatcatgatgatgacataatttttgatgatttcgcaagattacgacttaccaggatgagaaactgatgcatgaaatcgggtactggtcatcactcgtcgatttgtacccctacgtaacgaggtgtacttcacctgcgactatgtactactaatctacacatatgtatcgaaagttaatgttcgaaaaattgaatccaatggaacaatacgtattttggaagaataattttgagcgatattggtagattctaggaaaccgtaccgatataaccagtgtgtgtgccctagtc

SEQ ID NO: 6238 - DNA, 145 bp, Diabrotica virgifera
  Clone ID: LIB150-026-Q1-E1-E5
tcgtgggacgttacaaccccctatagtgacgtcgtattaagacgtcacatggaccaccgttacatatttgggatcgtatgtctagagtggatcggtactaagttcatcagaagatggacgccgttaaaatgaatctattgcaagt

SEQ ID NO: 6239 - DNA, 433 bp, Diabrotica virgifera
  Clone ID: LIB150-026-Q1-E1-E7
tacaacaccctagagtgagtcgtattaatcacatccagtaccacaaccctaccctgtgacagtaaccaagtatgaacaagtaaaagtacctactcctgtttacgtaaaagagcgaaaagtagtacacacttattccaactcataccaaaacttgcctgagaagcacatcgttctcaaacctcaagtttctgcacaagttccacaatattcaaatgctggttatgatgcttcatcatatagtagctctcttggaagttatggatctggatatggatctaattatggatctagttatggatctggttatggttatggaggtcatggcagctcaagctacaacttaggaagctatggagacagctataattctggtgtaagcggattaggatataacaatttgggaggttctagctcaagcggtttaggatatggc

SEQ ID NO: 6240 - DNA, 440 bp, Diabrotica virgifera
  Clone ID: LIB150-026-Q1-E1-E8
tcgtgggtcgatacaagcctctaaactgacgtcctagtaaaatctcgtaaaaagtgcagtgttagtgaagaatattttgggataagacaaagatatggactccaattttgaagccataatatgctgttcagatcagcgataaaactgttgattgtattatgtttggtggtgaaaaatgtgacgactttcaacccaaacgatgactactatgaccctcctaagtataacgcagaagtattcctgccagtgcctcagtacataggagaagatcaatctggttgcatatgccgtgaagttcctaacgttttcacactatgtttcggcatcaccaagtgcaacgcactacccataacactgaatataagtactccagtgcttagtattataggaacacatgtgtcagaaattcatgctggggatctcagtaatttaagtttttt

SEQ ID NO: 6241 - DNA, 397 bp, Diabrotica virgifera
  Clone ID: LIB150-026-Q1-E1-E9
cctatagtgagtcgtattaaacttccagtaacttcgtttttgtcagttcttttagttttatacaaagaaaaaatagcaacatgagtaaattcgttgttttattggcatgtttggcagttgttggctatgcctcagcattagaatgttatttctgcgacgattgtcaaggatctccaagcagctggccaaaaagagcttgtggcactgtccaacccgcagctggtatggaatgggcgtgttcacgaattgattacaaatccagagctacctacaaagatgccgtagacagaggatgcgcagcagtcccaaaggtgaatggaaaattaaacttcaattgcccaacaaccaagggagaatcaaaatcttgtgccgcctgtcaacaagacttatgttactc

SEQ ID NO: 6242 - DNA, 351 bp, Diabrotica virgifera
  Clone ID: LIB150-026-Q1-E1-F10
cctatactgaatcgtgagacgtattacgaattgaaaattttagaggagagacaaaaaaagtgtggagtttgcctatgtcctacgagtgaaaaaactttcgatgaccgaaagtgccgtgaaataaaataatacattgcgcttgtgggaattgtcatgcactaggttttaccgtcgagcactagatgcatccacattacaattttcgcagaaaatggacatggcaagttgcgatttagaccgacgatctgtcacttttcttcctgatgatcgatatatcagtttaatgtgattacctcaatttccataaatttcagacactatcatacatcgattaatcagtaatcagttcta

SEQ ID NO: 6243 - DNA, 244 bp, Diabrotica virgifera
  Clone ID: LIB150-026-Q1-E1-F11
tcaccgatacatttcataacaccaaaattagatgaccagagtagaagagtagaaggcttgatcatacctttttggtagttataattaacttacctatttgatattcttatttgctcaacttattctaacgcatatcacttgttaaatttagaactaatatacattcaaacaaaatcaaaagtacaaccttcttgttacagttttacattgtttattaaaaaaactgtgttaaaaaatggtaggt

SEQ ID NO: 6244 - DNA, 230 bp, Diabrotica virgifera
  Clone ID: LIB150-026-Q1-E1-F2
ttagtcgttgccaaacgggcaatcccaagttattcacattgatcgtcgggcaatctatacgggcgtatatgaagcagaaaaatctttaggcctccaacaggagatcggagaggtctcatagacccgtgtaatcaacgtacgtgcccttacacagcgtgaaagatcgctacattcggcgtgtccacttgcatgcaggcagatctgttggggtttccaggaaacatcgctct

SEQ ID NO: 6245 - DNA, 425 bp, Diabrotica virgifera
  Clone ID: LIB150-026-Q1-E1-F4
caacaccccaaaatgggtcctcataagccctggaaccaaaaaatttaattaaccaaatttgatttttcaaacattgttcaataaacgttaaaagaccggtaaattattgggtgtgctaaccggatggttccgtttgagctgcctcgctagtcctgttgtcgatgattctacaaataatcatattaattcggttcatccagaaaaatcaaccattgaagaatcacttttcaagaaactcaacgtgaaatgttccaatcaagatatcagttcctgcatgatgctgaagttggtaaactatttcaacaggctactaaagaagtcgtatattgaactaggtgacattgaaatcacacagacctccactgaaaccgttaacgtagaatcgtccagaggtttaaatgaagttgagaaaatgggagaagaag

SEQ ID NO: 6246 - DNA, 399 bp, Diabrotica virgifera
  unsure (1)..(399): unsure at all n locations
  Clone ID: LIB150-026-Q1-E1-F6
agncgtccgcttaactatatcttttattccacggtacatgcagcaaggcagcaagcacgtaccatcgtgtatcaaccacgctgtataccaagttggcccttttagtatacaggactagacacggggaatgttaacaatggattgactcccgactttataaataatggtacatacagaagttttatcgtaaatcgacggcatcgctattttatgtcacgtaatacagtagccgatgccgcggcatcagctacttaaggcaggtcacataggaagagtggacgataaccgttggactatacgaattgttgaaatgggacaagagaaagggggataagtacgtgcagaccacataccagacctcttgacaacatcaagcgaccgactgttccaccatggatg

SEQ ID NO: 6247 - DNA, 385 bp, Diabrotica virgifera
  Clone ID: LIB150-026-Q1-E1-F7
atagtgagtcgtattaattcacctcaatagaaaaactacaagaatatcaaaaatacaaacctaaagacccaaaatgagttgctgcccaccttgttgttcaccctgctgctccccttgctgtgtaccttgttatccctgttgcgtcccatgcgtgtactacccatgttgtttcccctgctgtagtccctgctgtagtccgtgctgtcctcccaaagggtgctgctagaagatatccatgggtttattgattttatgatcaacgaagtgagtgtgagtatgtcaaaaataaaagcaggtcataaaagagaaaaatatggaaacaaataaaaaaaaattaaatggtttgaagtttttaactcgaatagtgggctggtatctgcaaaga

SEQ ID NO: 6248 - DNA, 95 bp, Diabrotica virgifera
  Clone ID: LIB150-026-Q1-E1-F8
atagtgagtcgtattaaaaaatacgactcactacacggagtagttattagttgtacgacccacgtgtcggactcgagcggcgttttaacatgcta

SEQ ID NO: 6249 - DNA, 79 bp, Diabrotica virgifera
  unsure (1)..(79): unsure at all n locations
  Clone ID: LIB150-026-Q1-E1-G10
gtcgttgcacctccctatactgtatcgtgtgacgtattatcgaggtgtacattgantttgttgcaaaatatggggatcc

SEQ ID NO: 6250 - DNA, 382 bp, Diabrotica virgifera
  Clone ID: LIB150-026-Q1-E1-G12
gttgcaacatcctatagtgagtcgtattaaaatgtatgactcacataattggtttgtaatgaaatgtgagacgcttttaaagatatcgaagtttttaagaaataccttaaatttatgtattaacaatatattgagaattaactattttgatagtattaatattaaatatttttagggatgagcttaaaaataaaattttagtaaaatttaagttttaaataaaaattaggattaaaaattttcatattttaaaatatgttagtatttatgtttatagatcattagttgtagtttttataaattttttattaagatataagtttaagttatttaaatttagtaacgatgataacattagtagtaagaaattgtatatgtagta

SEQ ID NO: 6251 - DNA, 375 bp, Diabrotica virgifera
  Clone ID: LIB150-026-Q1-E1-G2
gtcgtagtaatatgtacgattttaagcgccatcgaacaattaagacatcatacatgatcagcaatgtcatctatcctcgatcacagatactaatatttatacaataaatatctcaggaaacatcaatacggtgacttcacaccattccatattaccattactagctgctccaatcttgcacttacaatatttttgatcaacttgtttttgggctgctgctccagacattctgaatattggcaagatagatacacaggtaatcgctggattgtctctctgtggacctcaactcctcatcagcaatcatccttacattacacagaacttcaacacgtccaaatagagaaccaaggtcccagagtaatctactagcct

SEQ ID NO: 6252 - DNA, 400 bp, Diabrotica virgifera
  Clone ID: LIB150-026-Q1-E1-G4
tacaccccaaagatgattcgtattaggaccttgaaactaaaaattttatttatcagatttgatttttcaaagatttgtttcaattaataccgtgaaaatgaactgtaaagtgatttgtgtggtgcttagcggattgtttctgtttgaagctgccctcgctagtcctgttgtcgatgattctacacataatcatattaattcggttcatccagaaaaatcaaccattgaagaatcacttttcaagaaactcaacgtgaaatgttccaatcaagatatcagttcctgcatgatgctgaagttggtaaactatttcaacaggctactaaagaagtcgtatattgaactaggtgacattgaaatcacacagacctccactgaaaccgttaacgtagaatcgtcc

SEQ ID NO: 6253 - DNA, 462 bp, Diabrotica virgifera
  Clone ID: LIB150-026-Q1-E1-G7
tcgcgtgtccatacaagaccctaaattgaatcatattatgattaattttatttcattttctttaatcatatttaattttaatttaattttattttccgggacaccctgtatggttggacaaccccgaacccaattataaatacagcgttgttttgaatgtaaataaaataaagccggtatattcattataagataaacaaatttaagattgtaactgttgcactacaaactttactttgttacttctaacgaaactttattcacactaaaacacttcaaacatcatgtgtaattcattaaaaatagtaataaaaactcattcacatcgagcattttttgtttattaattacgaattcctttggtttattttaagtttattgtatacaaaggttttttttatcaattgaggcagtacgaagtctgccgggtcagctagtaataaatatatttactaaaaacac

SEQ ID NO: 6254 - DNA, 406 bp, Diabrotica virgifera
  Clone ID: LIB150-026-Q1-E1-G8
cactcgaaataatctgccaatatgaatcaaagaaatttttcgattattttgactttgtttttgtgtgcatgtgtgggacatacattgcaaagtgaatttgccagaaatcctttaattcctgatgttgaatgcggccgttcggttgagggcccttcgtcttcacttgttggaaataaggagtttccctgagcagtcagaatttcatttagcaaacgtcccgatctatttgcatgtgacggagttttgataaaccaaagatatatcctgactgctggcttatgtgtagaagataagactttaacacgtcaaggaaatatagacaaaattcgcttaggagatcacaactgcttacccggtgaggaaaattgtgacagtaaggattacgttgatgttgaaatcgaaaacg

SEQ ID NO: 6255 - DNA, 101 bp, Diabrotica virgifera
  Clone ID: LIB150-026-Q1-E1-H12
atagtgagtcgtattatcgtattagactcactagagggagtcgtatgaagttgtacgactcactagtgggtctcgtattacgttgtattacgctaaagtga

SEQ ID NO: 6256 - DNA, 411 bp, Diabrotica virgifera
  Clone ID: LIB150-026-Q1-E1-H3
acgcgtgggtaaaaagtagataaaaatagcacaaaataaaaatttgttttaaattcgtattttgagatagaatctcacacgcgactatcgacgttacagaagtgagcgtgactactccggggttaagagcataagcgtaaaatttgcttgcaatactttttaaatttaaaattcacttttttcgaatcctgaaaaaactaataaatatttttgagaaatttaaaagctgattgaaatattacaatattaccgagggccgaaagttcctaagaacaaacaaaaggtttcttttgaataagatatttgaaattaagaatacactcaattctcgcgtttttttttcactctgtaacctattcatataaacattatagtgaatttcagactttcggccctcgaaaataatataat

SEQ ID NO: 6257 - DNA, 137 bp, Diabrotica virgifera
  Clone ID: LIB150-026-Q1-E1-H4
attcacattcttcggatcctgaaaccgctaataaatagttttagcatgtttataggctgattgagatattccagtattagcgaaggccgaaagttgctaagaacatgcaaaaggtttcttgtgcacacgatatttga

SEQ ID NO: 6258 - DNA, 353 bp, Diabrotica virgifera
  Clone ID: LIB150-026-Q1-E1-H9
ttacaacaccctaaagtgagtcgtattatactatagtatcagtaattttgtttttgtgcttaataatatggaaggaaaacgccgttgaagcaaataagaatttaccaggtaatctgataacctatggggacagtcagtactatattgatgataaatttaatcattgttggtgggaagcatggagacattgcaaatcccttaacatggattcagttagtaatggaacacaaggagaaaataactttccttaccaaaagttgaaggaacgatatggtaacggacccgaatattcgttttggactgctggaaccaaagaagggaacggatgggtatggaaaaatacaaatggtttt

SEQ ID NO: 6259 - DNA, 367 bp, Diabrotica virgifera
  Clone ID: LIB150-027-Q1-E1-A1
cccacgcgtccgcggacgcgtggggtgatttttaaggcaacgattggctacgaggatcgattatgcaatatcctggcatacattttggaatctggacacagctgcgcaataatcatcccaatttgaaaacatcccaatctatcactaggtacaaaacgaccagcaacacgatgagattgatgttgagctgatgccaatgtctcctaagctactatcaatcgcacacacttcaactccatatagaaatagtgagactcacaaccgtcgtcatccatattttgaataacttacgagtcaaattattaaatcaacgtctaaacgacatattacaatcgaaagtcctatagccgttttataagagattggt

SEQ ID NO: 6260 - DNA, 408 bp, Diabrotica virgifera
  Clone ID: LIB150-027-Q1-E1-A11
ggtcgacccgacgcgagcgagaggcattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatatagg

SEQ ID NO: 6261 - DNA, 353 bp, Diabrotica virgifera
  Clone ID: LIB150-027-Q1-E1-A3
gctcagacgtcactggaactgatgcgtcaggcaattgtgggtataacctgtgtctccaaaatgatatgtaaatgacgacgttggcatctcttattctgcatgagaatcaccactgttcgaacaatttcagcttcagagaaatcggtatgttatcgtcagcaaatacctttttaagagcttcacatggtacccgtcgtggttcgagtcaacttgaagtcgcagctgtatgggtagtgttgatataggcatgctgtctaggagtacattcattggagaatcgggatagtgtcatatccgatggtcatcatcagcaatgggcatgaatgttccttctacacataggtttctagttg

SEQ ID NO: 6262 - DNA, 405 bp, Diabrotica virgifera
  Clone ID: LIB150-027-Q1-E1-A4
aaaaaaaacaacagttggtttaaaccaagattttaagcatgttggtttaaacctgctaaccctggtttgcggacagtaagagtaaaatggggtggagagtcatattgttgaaaataaacagtgtgagcagttccctgaactctcaagggcggttcatgcgatgaaacgccgtcaaacattgggcacgttcaccagaacgttcaattttgagtgcgctcagcgctttgaaactgtttaagctttttctggtcaatgtcactgaatttaagctaaacttcaacgttttgacaaagccgtcgccattttattcagcgtagatttacatcgcttaatatagataacgtgtttaggaaatttattgtaatggcgcgctaattgaaaatatttacttttacaataatttta

SEQ ID NO: 6263 - DNA, 416 bp, Diabrotica virgifera
  Clone ID: LIB150-027-Q1-E1-A8
attcgtctttccgttgttgccctgagcagctgcttaccagcatccagaactcaacaatacgttgatgtatactacaacagctacaacgctcatcccgtctacaagcttctggaggacttggaatcagcaacactatggacaagaaccatgggaccaatgggtacaatatggtgtccagaaccaacccggtaactactggaggcagtacgtgcaacgcagcaaccaagctgaatatgtcgatttaccttggctgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatacgttgtatcaacaccttcctgaac

SEQ ID NO: 6264 - DNA, 392 bp, Diabrotica virgifera
  Clone ID: LIB150-027-Q1-E1-B11
cggacgcatgggcggacgcgtgggttgcagtccaattatgtccaaattacaccaatctggaggtcaaggcaacactccttatggtggagggatgccgggaggttgtacaggacaaacggctggtgatggttatggaggaaaacaaggagacggaagtggaccaaccattgaagaagtagattaaatttatcattttttcgatatgatttctttttgtaagactgattttttagttgtaacatatttctataatttttctacctcatatactcatgtactttgtttttaagtaattattaaataaacaatgtttaattaaaaaaaaaaaaaaaaaaaaaaaaaaaaaaaaaaaaaaaaaaaaaaaaaaaggaaaaaaaaaaaggggggccccc

SEQ ID NO: 6265 - DNA, 387 bp, Diabrotica virgifera
  Clone ID: LIB150-027-Q1-E1-B2
cccacgcgtccgcacatatgcctcatttagaaatcaaaccacccaactagcaatcgcaaaaaaatccagttccggattaacaaaaaatataaattcatggtgaccttgaaacaaccaaaagtacatccaagtgtgaccctgtacatccagatttttaaaatccgtttgcatatttgaaaagagtacaaaaaactaagtggttcgcttcaatcaccaaatacttcttttttttttggttgatcatgtcggccttcgacaataatccataaatattatattatactaacacgtcgctaaatagttctaaaaacaactgagttttatataaaagcagactaaaaatctaaaaattaatgtattaattcagaaaacacaaaaaaatcgctg

SEQ ID NO: 6266 - DNA, 420 bp, Diabrotica virgifera
  Clone ID: LIB150-027-Q1-E1-B5
caaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcatcacttaaccaattggtctctcaagaacaacagttgagcttgagacagccacaaatctaccagagagtaccacgtgt

SEQ ID NO: 6267 - DNA, 231 bp, Diabrotica virgifera
  Clone ID: LIB150-027-Q1-E1-C1
tctaaagtgaatcacgatacgagtgagcgcatttctgagattgatatagtttgcatacatctctgttgacactgatttgtcgatctacgggccgaggtcaggatacccattgtgaaattcgatctctgcggcgatctttagcaacagactttgatgcgatatttttcattttgtaccgaagaacttaccgttagatatttacaacactagcggggcattcgttgagaaatt

SEQ ID NO: 6268 - DNA, 385 bp, Diabrotica virgifera
  Clone ID: LIB150-027-Q1-E1-C10
caacaaacaccgccttcaagatgaaacgatccaagcaagttaccgtcactaaaaccactacgacatatgaagaatacgaatatgaaaccactttctccgtttcgaagttatcgaaacttgagaatttcgttttacctcctagaactactatcttagcattgtctcagagcggaggagacaaggaagaagacaaaaagtatgtcgtcaccaatcacggaaaagctgatctttttgttgaggtaattcatctcaaaaaccaagatgatgctccacaatggtttgtagtccagccagaccaaaccactgagatagatattgaggacaatcttgaacaaagcgtattgaaagtgagcaacaacagttacgaacaggaagtgtcaatttc

SEQ ID NO: 6269 - DNA, 384 bp, Diabrotica virgifera
  Clone ID: LIB150-027-Q1-E1-C2
tacgctcgacgaggcaggggggctcgccacgcacgacaacgaagaattttgctatgtgctgtcaggcgaactggaactgcatttcgaacagggtgaaccgacgctgttgcgggtgggcgaaagtgcgctgttttcgtcgcttcggccgcatgcatacgtggcgccgggcggtgccacactgctggtcgtgctgacccctgccggatacgcgcaacagaaacctgctttaccgtaacgcgtcccggcatacccgcaacgccgggtggcatcccgcgcccggcgctcggcgctcgataacggcacgatgcatcggaaggcaacgtgcgctcgaacggtatgtgtcgccgttccgtgtcgccgtgagtcgtaccggcgcgcgccccg

SEQ ID NO: 6270 - DNA, 402 bp, Diabrotica virgifera
  Clone ID: LIB150-027-Q1-E1-C6
cccacgcgtccgcaactccttcaaaccacctaattcgctgtcggtttctgcttcttattcctaaatgtgttcctgtggttagctttttaacaagtgtgttgtctggcattcgtattatgtgtccagctcatctaagtcactgttttaatgaacgttatgacatctggttcattaaagagttggttcaccacgagtccagagtataccctatttgtaaggtttattcgtcttttaatttctttgcttgttttgttaagggtaatccctagtgagccaaggtatgtaaagctgttaacatattcaaagatatgacttcccaagactgttttccattcctcatatactatagtgtcatatactatacgttgtaatgacatgtgcttggtttacttaagcttatac

SEQ ID NO: 6271 - DNA, 412 bp, Diabrotica virgifera
  Clone ID: LIB150-027-Q1-E1-C7
accacgcgtccgcaactccttcaaaccacctaattcgctgtcggtttctgcttcttattcctaaatgtgttcctgtggttagctttttaacaagtgtgttgtctggcattcgtattatgtgtccagctcatctaagtcactgttttaatgaacgttatgacatctggttcattaaagagttggttcaccacgagtccagagtataccctatttgtaaggtttattcgtcgtttaatttctttgcttgttttgttaagggtagtccctagtgagccaaggtatgtaaagctgttaacatattcaaagatatgacttcccaagactgttttccattcctcatatactatagtgtcatatactagaagttgtaaggacatgtgcttggtttaattaagcttatacatatgcggtt

SEQ ID NO: 6272 - DNA, 397 bp, Diabrotica virgifera
  Clone ID: LIB150-027-Q1-E1-C9
cggacgcatgggctttcgctgaactgtttgatctaggagagcttcatctttccgacaataacatccacaaactcccacctactgcgtttattaataaccaagaattaatcacccttaacctcgacaacaacccccttaaacattttaacattaatacatccgacagtttagagatattgtcacttaagaattgccaattagagacatttgacgaagaatcaacaaaaaaattaacttctcttaatgaattaaacctaagtcacaacaatcttacagacatattcagtaaagcattgtcccacatgcaggatctttcagtaattgacctttcttacaataagttgactaaacttcaagataatattttctctggaaacggtaaactcatcaaagttat

SEQ ID NO: 6273 - DNA, 383 bp, Diabrotica virgifera
  Clone ID: LIB150-027-Q1-E1-D11
agtccttgagttctgagcatacgatggtaacaccacaactcagatgcttctgatttattaagattttttctcttagatctgcggtcaatgactcctctgcagcacaatgcagaactccagttaataaagctctttcgtgcaagttctattctggtcgaaatttcctcgtcgctttcaaccctgcagtcaatctagctacccagatatctaaggtgttccaccctttccaggattttgttatctaattttagtaccgagtcttcgatagtaatttctccgaccgcgatccattttgttttctttgcgttgattgttaagtccttttcagtgcattcgttgtttacaccattcaacagggtttgaaggttttctagactgccgtt

SEQ ID NO: 6274 - DNA, 397 bp, Diabrotica virgifera
  Clone ID: LIB150-027-Q1-E1-D2
tcacgggtccgagcacgcgtccgaggacgcatgggtaaaaaacaagccttccgggcagttattatgcaaactctttattttgtttagaaccgtgaatcaaatttagtatttgtttacaaaatagtttttattcatacatccgaatttttccgtaaccgattgagtcgaaaaatattcacgtttgacaacaccgcaaatatttaaaaacctaacttctttcacgctcgaagcccacgttgttccgagaaacaaaaacgatacaaatacaggaatcagcaaaaagttatcacagagttttttttccgatacgtgccgacattaaattttaccgaacaatttgtttcgaaataagaatattactatttactaatacagaactaagcaaagcaaactgtaa

SEQ ID NO: 6275 - DNA, 374 bp, Diabrotica virgifera
  Clone ID: LIB150-027-Q1-E1-D3
agtttttagagctgaaggaggagatgttattgaagatcttgaggatttagttagaaatattgatgagcaaaaagaaactgttgttactcatattctaacaactttggagagcttccatttagtctcacgttcgtccgtcactgctttgatgtatgatcctaatgatgttaccctttccgaacatcataacttcactgttaccaacaatggacaatctgaaatagaagttgaggtgacatacaccgacagcgatgaccgtgccaatgatcaatacagggtagttaaaccaaatgaaactgtagtaattgagcataacaaagacgctggagtagctctattaaatatattgaacagacattacacagaagtcgcta

SEQ ID NO: 6276 - DNA, 408 bp, Diabrotica virgifera
  Clone ID: LIB150-027-Q1-E1-D4
aggacgcgtggggaaaaaacggttctgtatgaatagggcttttcaacgtttctcatttacttcgggcacttgtcatatgtcgtatattaatattatacacagattatacaacatacgacaaattaagatatctatgtcatacgtttttggtttgtatcattggtatatacgaataacgtatgttccatgggtgttcgggaacgattaacttaaattaaaataagtgtaaaaacaacaacttgtcaataatatatttatttgtgtcggtaaaatagcgtgaatatttctcgaaagagggtttgttattcttttgcgagtatggtggtgtgtccgcgccggatggttgctgtggctatactgaaagaaaccacaaacgctaatatgtttgtgtttctaccaactgggcag

SEQ ID NO: 6277 - DNA, 109 bp, Diabrotica virgifera
  Clone ID: LIB150-027-Q1-E1-D5
tcaacacatcaatcacacagtgctgtgtctactactaatatctatgtaatacatattcaatcatctgattcaggaaaatcgtgtccatccatgactggacagttacagt

SEQ ID NO: 6278 - DNA, 401 bp, Diabrotica virgifera
  unsure (1)..(401): unsure at all n locations
  Clone ID: LIB150-027-Q1-E1-D6
accacgcgtccgcccacgcgtccgcaaacacaagaacccatatgttccaagttggggaaccactgagaactggagaagctatcgaccgtcgtaccctcgctggtgtttcagtttaccaaatctacaaccaagctgatattcttactgatatttttcgtcagtatgaaggtactcttgacgacaccaaatactatagccttcttaacaggattcaaatgtgagttgaagctggagtcgtcaacgaaaccatctacgatgttattagaaactgggatcgtgaataccgtatgcaatgaattagtgacattgtccccgtccaaggagtacgtaccctccgccaatatgctggacaggtangaaatgttatgcctcttggacaaaatttggaatatggaaaccat

SEQ ID NO: 6279 - DNA, 415 bp, Diabrotica virgifera
  Clone ID: LIB150-027-Q1-E1-D8
cttttctatagaatgttgaaaggttcatttctacgtcgttatcaaaatatatcacgagcattatttcaaacaaagtgtattattaccatactcatctactctagtctaaagtgttatccagtagtaaagtattgatttttacagtattattttatacttaaagtgaaaaatggcactggagagtttaaaaaatatagtggttggacctgaattagaaagaataatagatacatcccttggagaattattactattagttctaaaaacttttgaagataatgtgattcaggtagatggagaaaccggagaagaattaccagccaatttgttgttaaaaagaagtattagattgtcaaaatggttaacaagccaaggcattaaagtaggtgataacatttcaataaatagtgaaaat

SEQ ID NO: 6280 - DNA, 398 bp, Diabrotica virgifera
  Clone ID: LIB150-027-Q1-E1-E1
tccgaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaacagaaactgaaatggtcgttctggaaaacttttctttaagcccaagaactgctgtcactgttttgagtcaaaatgttgaaggaagcaatgaacatcctggaaagtatactgtaactaaccttggaaaagctg

SEQ ID NO: 6281 - DNA, 393 bp, Diabrotica virgifera
  Clone ID: LIB150-027-Q1-E1-E3
gtccatgcacgcctctaaaatgactcttgctaaatgcaaagtctataaccacgtagtagaatgcgtctgtccaccatgaacaatcagcgatggtaatacgggttgcttaacaatagaagagaaatgcagggttgactctgattgtccattacaatttgcttgcattggatttaagtgcattaacccctgcatagctaccgaaccatgtggaattaatgcggaatgcacagttttgaatactgaacctgtgagaaccatggtgtgcctctgcttgccacgataccaatgaaatgctgctaacatatgcaatccaattgcactctgcagataatataaaggatacatccaaacaccagatggtcgattcgtatgcgcaccgaacttagctctcaa

SEQ ID NO: 6282 - DNA, 400 bp, Diabrotica virgifera
  Clone ID: LIB150-027-Q1-E1-E5
aacacatcactttcatcacattttcattcacctccaataggagatacaatacgcccccaaacatctataaccttttcaaaatacttactaatcctagatatctaaaattattacttttcaccaacattttgccatccagatttaacattttacttgtagcagcttgatcttcaaatcagggccgtgccgtactatgatgcggtgctatgatgcggtgaggcagtcgcatcaggcggcatcataagaagggcggcataatcagtaaaatcaaatcactctttagttattttaaaaatgaagaaagtatcttcttctacaaaaacgacaacgttttttttgtaatacaagaactgaacactttttttctggttctacaaagcgttgggaatttccggaaaaa

SEQ ID NO: 6283 - DNA, 393 bp, Diabrotica virgifera
  Clone ID: LIB150-027-Q1-E1-E6
cacattggtcagccttattttgtccaaatacagtactctatcctcatagtccagtgaacttttatataccgatagttatgtagtattgtgatagaattaaattagtcttcagaaagataaatttattttttgtaacctgtgtaacagggattacgaattactagttacatagttactattttcgagtttaatcgaggtaatcccctatgctttttattgttcaacaggtattttacacaattttttgtgtaacgacacgtgattcgattttaactagaccaacatttctaagtaatgcctgtcgtttaatgatgaatgatatatttagaattaactaggtatatatgattagtcttacttaatgtgagggatgagctgaaaattggcatttta

SEQ ID NO: 6284 - DNA, 419 bp, Diabrotica virgifera
  Clone ID: LIB150-027-Q1-E1-E7
cacattggacatccaaaaagtgtccaaaaacagaactctatcctcatactccattgaactacaatattcccacaaaaatgtataagaagacgtgattttaatttgtctctgacaaattatttttatttagattatacatttctataaaagtaacgtttttcaagtacatttgagacattaattttgttcaatcatggctatccccattgcagctcgtagttcatcaggaattactctctatgaaggattacctactcctggtaacaagccaacatgtccaccaattcagagtaaggcctgtcgtaccatgttgtttgatcaagacggaaaatacttggcatatgtgaatggacaaactttatgtgtgctacaaactgaaaattggcagacattggccaacatagagaacgttaaagcct

SEQ ID NO: 6285 - DNA, 55 bp, Diabrotica virgifera
  Clone ID: LIB150-027-Q1-E1-E8
acgcgtccgcgacgagagggctgtcggccacgtcgtgctccgtcgaggcggcgtc

SEQ ID NO: 6286 - DNA, 355 bp, Diabrotica virgifera
  Clone ID: LIB150-027-Q1-E1-E9
aattatgtacgattcacgtggcaaatgtgttcacgagcttgcggtgatattcaatggagaagatagtacatgttctccatacaagattcacctagactcatttagttctggttacgtaactgcatacggtctcggtcgtagtcacggcattactggtgaacccatcaacctcactaattccaccatatgatccgagcgctgggggcttgtctattaccgtagaatgtcccagtaaagctgatatcagttgtcatgatgttaatcactgtaacgtgtcggtatcttatcttcccacagctccaggtttagttcaagatctcagttatatttggtgactatcataataatagatctc

SEQ ID NO: 6287 - DNA, 274 bp, Diabrotica virgifera
  Clone ID: LIB150-027-Q1-E1-F10
gttaaaaatgttaaatttttttataacaaccgaaaaagatcggcgagaggctgccataatagagcatcgtcgtgctatgagaagaagaacgagagcaaagaatcttcaatcgccgtgctagacttataggaatcgacgcgctagcattgcagcaccatgtagaagagaagagcatagaaatgacgaagaacgacacattgacaggacaatcaaatagcaacgtagcaggtctgacgaagatgcgatggtaggtgagcatatggagtgtgcagaa

SEQ ID NO: 6288 - DNA, 370 bp, Diabrotica virgifera
  Clone ID: LIB150-027-Q1-E1-F11
acggacgcgtgggataaagttaccactctttgtaatgaagaaagttgacgagtaaagtatgagaatggagacactgcttacgaggcaacatttatgttcaatgacctgtaattttgttggcgagaaatttaagcattaacagttaatagaatatttggcttgtggacattgtttgtcacacaacgaacctagtagaatgttttaacagtgccatttattaataatccaacggaaaggcatattgaatatcctgtacattttaacattaatttaagaattctaattcgtgaatatcgacatccatattcgaaagatagacttggaactaacatatgactagaatttttgggttccccgattgcaccaacgt

SEQ ID NO: 6289 - DNA, 401 bp, Diabrotica virgifera
  Clone ID: LIB150-027-Q1-E1-F3
ataaattcagttccatagaacccttcagagcagtggtagatagagtaaagatagtgatgatgatatccaacctccgattttgtacacagcacttaaagaggaagaagtagaattgaaaggcagcctgaaataattatttttttaatataaggatttttaacatatttcgacgcttcgagtatggctaatggttccgccgagaagattgaaaaatcattgcacgacaatttgtccagaatatcagccaatatccatttctcggtataattgatacagaagtactaagtgtgtatggtgttggttcttcctagctggcaattactattaaaattttactattttcgcatctaaactactattctaaatcaggtttgtacatacgatcacaaactgaaaatcaa

SEQ ID NO: 6290 - DNA, 420 bp, Diabrotica virgifera
  Clone ID: LIB150-027-Q1-E1-F5
cccacgcgtccggtaaaggataccactggtctgattggtatgttttcaaagacatcagtcttgtgtattttcatgagaccatatagtctgggaacgtttgctttagatggtaaaagtttctttttagtagtagtatcagaaacttcagtgattttattgatggctgttctaactttagtagtgaaagtattaatattgacagattttgttagaaattggttatctagtataaaattagtgactttttgatggtagtcttgggtgtgtaagacaactacagtgctgcctttatctgcattagtgactgtgaggttattttcactagttttcttatcaattgatttaatggtgtccttatattcattgagagggtttctgtgatagccctttctgttgttacaaataacctccttttcattt

SEQ ID NO: 6291 - DNA, 361 bp, Diabrotica virgifera
  Clone ID: LIB150-027-Q1-E1-F6
cgtccatcacaagtgcagtggacatcagtgaaaatgagaaaattagtgttagtgttgttttttgtgatatgtgcttatgcacaggacaatttcgaaaataccggcgttagattagcactgaaaatatacgatgactgcacaaaagccgatggattatcaccgtgtttaaaaagaaaagctatcacttttctagacagactgagccgtatggataaattcgcactaactgacggagttacggtacaaaaggcatccgatgcagtcgctgaaggtccagcccttaccgaggaacaacttgacaacacacttccaaggtcttctgacgccaaagatgcagctttaacaaacatgctttctgaaa

SEQ ID NO: 6292 - DNA, 53 bp, Diabrotica virgifera; identical to SEQ ID NO: 5893
  Clone ID: LIB150-027-Q1-E1-F7

SEQ ID NO: 6293 - DNA, 397 bp, Diabrotica virgifera
  Clone ID: LIB150-027-Q1-E1-G12
tacacacgcgtccgcaacaacctactgcgttttagttcgcggttttgagcatttcttatttttatttatattcgcgaagcaaactgttgtgaggttagaggttagtggtatcttgctaaatcaagtttgaacaatagtaaatatttaatcagataattaaggaatacaaattattctaatgagcagttttggatagtttaatggtgattagtataaagaaacatttgaaggtgtgaagttataggtacacatattaaacaagaataatatacataaacagataattcaagatgaagcacaaatatgggcttgtcgttctactgatttgtctgccagtgatactgagtataagagttcctcccaatccatgccctaatatgtttcactactacaaaga

SEQ ID NO: 6294 - DNA, 352 bp, Diabrotica virgifera
  Clone ID: LIB150-027-Q1-E1-G4
cgatttgggatattattaacataattattcaagtgaaccttgttcccgttgcttattgttaaaaccactgagaagcacaatttatactatggctaaaacattaaataacttagtaataaaccgttttaacgtgacaagcaacgtccatatcttgggaaactgcaatctgccacactgaacccttttaacaaacttactcctgtttaacacctagatctgtgatatttaacagtccagcgctagatcaatcctgtcgaattcaaggcaccgatattaacgatgcagctaatgatgaatctaaaaggtctgaaaatgagatacatgacacagatgtcctcaaagatactctttc

SEQ ID NO: 6295 - DNA, 352 bp, Diabrotica virgifera
  Clone ID: LIB150-027-Q1-E1-G6
ctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaaaatccaagaaaagaaacttgccgaacctcctccagctatcaaagagccaattaagggaagaagtgaggccaatcgatcaacttctggtttgga

SEQ ID NO: 6296 - DNA, 248 bp, Diabrotica virgifera
  Clone ID: LIB150-027-Q1-E1-G7
atctcacactcgcgttagcttacagtgacacatacatataccatcgagacaatcaacaacaatcaatactattcaaggcaatttgtacactctgatacagcacaatagtgccgcaatcagatatgcattctatctacaaatcgcgtttgacatgaaagatgaccttcggctcataggacttcatcattaatgattcatgagtcacaggatcagttctcataatcagactctctgacaggcaagatttt

SEQ ID NO: 6297 - DNA, 387 bp, Diabrotica virgifera
  Clone ID: LIB150-027-Q1-E1-G9
gggtcgcttgagcagactcgagtgcagtagcggtgggttatcgtgtgatagtaccacatgcctgagttcgaacttttaaaacatttagacatagatacggaattaggaatgtgagagaataagttatgctcaaagacaacatcattagattgtggaccatgtgtatcacggaatattacagtggaattatgaaggtagaaagacccaattgtgtacagcatgaccgggttggcttttattgtcatcaaaataccgtcactaattttttagctgagaaatgttaaacgatttcaaatagatctaatggtttacgacaatgatctaaaggtagttaatattgatacgtttataaccaaggatctttacactactacgattaaacccttt

SEQ ID NO: 6298 - DNA, 369 bp, Diabrotica virgifera
  Clone ID: LIB150-027-Q1-E1-H11
cccacgcgtccgaaacaccgccttcaagatgaaacgatccaagcaagttaccgtcactaaaaccactacgacatatgaagaatacgaatatgaaaccactttctccgtttcgaagttatcgaaacttgagaatttcgttttacctcctagaactactatcttagcattgtctcagagcggaggagacaaggaagaagacaaaaagtatgtcgtcaccaatcacggaaaagctgatctttttgttgaggtaattcatctcaaaaaccaagatgatgctccacaatggtttgtagtccagccagaccaaaccactgagatagatattgaggacaatcttgaacaaagcgtattgaaagtgagcaacaacag

SEQ ID NO: 6299 - DNA, 322 bp, Diabrotica virgifera
  Clone ID: LIB150-027-Q1-E1-H2
cttttaaatatatctaattttttaagaaataaattaaatttatttattaacaatatatttataattaaatatttttatattattaatattaaatatttttagggatgagcttaaaaataaaattttattacaatttaatttttaaataacaattaggattaaaaattttcatattttaacatatgttattatttatttttacatactattatttttatttttgatcaattttttattaaaagatcaatttacattatttacatttagtaatgatgataatattagtattaaataattgtatatttagtagaaatatatacgt

SEQ ID NO: 6300 - DNA, 364 bp, Diabrotica virgifera
  Clone ID: LIB150-027-Q1-E1-H6
accaagcgtccgcccacgtcgtccggaaacgaaagtgatcggtactagatgtttaagcacgtttttcgatcagtgacactgaatatgtggtcatggttatatttgtgttattacatgtggcaattattagcatatcaaatgcccaatttcgaacgtggttacaaatccccggagcccttgcagttttagacaattcccgctcctttcaacttaggcattatgggctcaacgctcatgacttcgttccattaccatcatcacctaatcctataccaactcgggaaatagcaacagttatcgaagaaccacaggataattatccttcggtacagccagaaccacaatcgtcattaaccagtcttga

SEQ ID NO: 6301 - DNA, 381 bp, Diabrotica virgifera
  Clone ID: LIB150-027-Q1-E1-H7
gcttacaccgctttcatgatgaaatgatcacatcaagttacacgtcacataaaaccactattacggatgaacattacgattatgtttccacattctccgtttcgaagttatcgattctgaagaatttcgttcaacctccaagatctattatcatatcattgtctcagagcggaggatacaatgatgaagactttttgtatgtcgtcaccattcacggaaatgctgatctttttgatgaagtatatcatcacaaaaaccatgatgatgcaccacaatggtttgtgttcaatccagagcattccactgatatagatacagaggacaatcatgaacatgtcgtgttgaaagtgagcaacagtagttactaccaggaagtgtcat

SEQ ID NO: 6302 - DNA, 382 bp, Diabrotica virgifera
  Clone ID: LIB150-028-Q1-E1-A1
attagttctcttttctttagttgcactcagcgttgctctaccaacactccttggtagaaccgtaagagtcacagaagatggaactgtatctctcttcgactctagaggataccaactcgtaatcctcaagagtgttaccgattccagacaagtcgaggttgttctcagaagtccaaacacaagaacccatatgttccaagttggggaaccactgagaactggagaagctatcgaccgtcgtaccctcgctggtgtttcagtttaccaaaactacaaccaagctgatattcttactgatatttttcgtcagtatgaaggtactcttgacgacaccaaatactatagccttcttaacaggattcaaatgttagttgaagctgga

SEQ ID NO: 6303 - DNA, 237 bp, Diabrotica virgifera
  Clone ID: LIB150-028-Q1-E1-A10
caagcctctagagggagtcgtagtagaaggattgtcaacagaatgccgtataatagacggcctaatagaggacgtattagggagaggcctagatatgattatgatgacgaggaagatgatctagttgacgatgaggaggatgttaatagcaggcgagcatgtcccatcgagacagatagtatatctagttccagaaagtgaccatcacagggaggcagtgcatgagcggtagctgta

SEQ ID NO: 6304 - DNA, 223 bp, Diabrotica virgifera
  Clone ID: LIB150-028-Q1-E1-A11
aatttatttcccatatgattagtgtacttaattcaacttcatattgaccttgtacatatacaaacaacaaatactacaacagcgtccaagatgcgactttcaatattgtgtatatcactaattatcggtgtgttcggtcaaaatgaagaaattattgatgaagacactatggagaaaatagatgagatatttcctatgagcaacaataaatttcccacagact

SEQ ID NO: 6305 - DNA, 329 bp, Diabrotica virgifera
  Clone ID: LIB150-028-Q1-E1-A12
tatttgggtacttcactgaacaacattcggtttgtgatttgacacatataagcctagttttcgtatagctatagctctgcatctgcataagtatatagcccagacatataacagcagttttttgtcagttttttacatgttagatttttgcaaaaagtgtttttttcaggaaaatactcacatgatgagttgtatgtatcaaaacgtctgggaacatggatactttgttgcataatgaacaaaatagtcactcgtcaataactcgagaagtgtagacttggtgaggaaactcgagggaagataactggatgtagatctgggcactttaa

SEQ ID NO: 6306 - DNA, 139 bp, Diabrotica virgifera
  Clone ID: LIB150-028-Q1-E1-A3
ccctatagtgagacgtattaatcggttcgtgtttaaatatatctaattttttacgagataggctggatttatgtagtagcaatatatttataattgaatagttttatagtattgagatcgggtatttttaaggatgagc

SEQ ID NO: 6307 - DNA, 389 bp, Diabrotica virgifera
  Clone ID: LIB150-028-Q1-E1-A5
acggacgcgtgggttcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgtttattaaaaacatg

SEQ ID NO: 6308 - DNA, 410 bp, Diabrotica virgifera
  Clone ID: LIB150-028-Q1-E1-A9
aggggcaatggcggtcgaaggaatgaaaacagaaggccgtataatagacggcctaatagaggacgtattaaggagaggcctaaatatgattatgatgacgaagaagaagatcgatttgacgatgaagaggatgttaatagcaggcgaagaaaacccatcgataaaaataaaaaatctagttccagaaaacgaccatcagaagaaaccagtgaagaaacagtatcaaaagaacaaaaaacaaaatcagacacaagaacaattataaaaccagtcagtggaaccatatatgaccgaccacgggtagcgcccaaaattaaactaccagtaccgaaaaatgaagcaaataaatatgcttacaaaccatattcaacaacaaaagttactcaaaaagaaaatgatgaatatgaaaa

SEQ ID NO: 6309 - DNA, 392 bp, Diabrotica virgifera
  Clone ID: LIB150-028-Q1-E1-B1
cgagtgagtaagtctttgctggtctcctcctgactacccaagccaagctaaaatctgcaaagttccttttagcctttttgtataaatagaaatcaaaatgtctgacgaagaagttcaaaccaaaaaaggccgcaaagcagcagctgaagccaccaaacgtaccaaaaaggatgcgaaagctgaagttgaagatgctccagtagccaagagaggcagaggaaggccaaagggaaccgcaaagaaggctgaaaagaaggaaaccaaagccaaatcaaatggagtgagcaagcgtggtaggaggaaaaaggaagagaaggaagaatcagctgaagaagaaaatggagacaaaagcagtgaaaatgaagaagaggaagaagatgatgaataaattg

SEQ ID NO: 6310 - DNA, 407 bp, Diabrotica virgifera
  Clone ID: LIB150-028-Q1-E1-B10
aatttggtggttggacaagcagtaaaggatgagatcgcttctatttcttctgcttttctatacctggcaaatctctttcgcccaaaagtgttcgagtccggaagtatcaagaaagttatcatttatttatagaacagtaccatcatctcaaattgaagtggtagaatgtttctatactgacggcaactcgaaaaatgattattacgatattaccaaaaactgcgttactgctgccaggaccagaatattcattgataaatatggcgacgatcaccgtgttaatgagggaggatccaaagtttctcttaaaacgtactataccaatgctgatctatcacagaacgtagtttttctcaaatccggaaagaaatgcaggtatgacgctggtttttgctatgacccttccc

SEQ ID NO: 6311 - DNA, 392 bp, Diabrotica virgifera
  Clone ID: LIB150-028-Q1-E1-B2
atccggtttgctcactcattttctttatttagttcctatgaccaagtgtccgtttatgtttgaaccgttaactgtggtaattgaaatatatcgtcaaaggtaaacgttttcctaatattcatcgattttttgtttcaatatttcaacttatttcttattcgcaagtttagaaatattatattatcaatttctatagtttaagataatctataaaatattgttatggaatatccttagctcttttccagttttctttaaatggttctagcatcttagttcccgattataagcagcatattactgcctgtctttttttcgtccacgtttaaatgattcaatattattttcacttcagatgaatcacgaaaaataatgcactttttagaatgact

SEQ ID NO: 6312 - DNA, 420 bp, Diabrotica virgifera
  Clone ID: LIB150-028-Q1-E1-B3
ggaagaatgtctgtgcgtttgcgactctgtcatcattttttgacgaaaacgaaatatctcgaataagagatgtggttgctgatataatttatcacttggataggaatttcttcaagaaagttttgataaatatttctctgaagattattccaaacttgactgaatcagaaattgttttgcaggaagcccaccaaataagttagaattacaggatttacagaaaacattcatcgatttcacagaagacacttttaaaaagaaatccttaattgacttctggatgaaataaaacaagccaatggacatatttttgatagcaaatatgtttccaaaaaaaattgggaggcttccttttattccatgtcccccccccccccaacaacctgtatttggtggtacaccaaaatcttcaaaaatata

SEQ ID NO: 6313 - DNA, 380 bp, Diabrotica virgifera
  unsure (1)..(380): unsure at all n locations
  Clone ID: LIB150-028-Q1-E1-B4
cccacgcgtccgcgagtacgaggcagatgtatattctattgagccataagaaaggacgaggtaaaaagtcacatggttttgagtctgtgataaaagagggacgtaagtttattgtagagaaccttttccttctgctgtaatgcattttgcagcttttttcttctactatctaaaatatttagatgccagcatgtagtttaattcaattaattgatgagaagctgatttgtgaacaggaataacaccaaattaatcgcaagcaagaacaaaaaaatcacatgatgtcaagtctgttctagcacatgcagggatagaagaaaacatattgtaaaatgcaaaattccggtgtantgtctttaatttgtatagtaacttccttc

SEQ ID NO: 6314 - DNA, 395 bp, Diabrotica virgifera
  Clone ID: LIB150-028-Q1-E1-B9
agccaagcgtccgattttaaattaatttaaaataataaaaaattttttaggaaaagttaagaaaaattttatttaagggaagttaattagaatgggggaaaaaaatttaattttaaaaaaggaaaaattaatttttggaacctggggtaccagggataataaattaaaaataaaaaattaataatttccaaattaaaagaagcaaaaaaattaaaattttaatggtaaaataaaaatttaaaaaaattttttggaaaggaaaggtaatccgttttaaaaaaaaccaaatttttaaggaattaaattaaattaattaataaccataaaattaagaattaataattttaaaataataataataaataattttaagggagaaccttaaaattaaaatt

SEQ ID NO: 6315 - DNA, 374 bp, Diabrotica virgifera
  Clone ID: LIB150-028-Q1-E1-C2
tacaaaataactacctactgagaaatacgattctcgatatgattaccggtactcaaatacaaaagtaatcatagtaatccagtcatttttatcccttaaacagatcggtgaaggtcgttgttatatcggaatacctatacaaaatacctacctactgggatacgattctcgatatgattaccgttactcaaatacaaaagtaattatagtaatgaaatcatttttatcccttaaacagatcggtgaaggtcgttgttatatcggaatacctatacaaaatacctacctactgggatacgattctcgatatgattaccgttactcaaatacaaaagtaatcatagtaatcaaatcatttttatcccttaaacaga

SEQ ID NO: 6316 - DNA, 401 bp, Diabrotica virgifera
  unsure (1)..(401): unsure at all n locations
  Clone ID: LIB150-028-Q1-E1-C3
cggacgcgtgggaaaaattatttagaaaaccttatgtccaaaagtgcaactgtagactgttctaacaaagcgaacaagttattttttaggtctcggatgtacttccgaattaaagaattaaacaagtctcttaacaacctgacattgcgtaaaagaaaaattatgaaaactgctacatatttgctgtatgtacgtctatttcacatgcacaaaatttaaataaagtgcatggcatgaaaactgtaaaacttatttttgtcttttccaagcctcttacttaaatctgatgaaatacattatttaaaaagtaaaaaattttgtttttttatcaatccattaaatttatggttttattttgaggcttttcttcnccttggtaaaaattatatttactaatgtgt

SEQ ID NO: 6317 - DNA, 67 bp, Diabrotica virgifera
  unsure (1)..(67): unsure at all n locations
  Clone ID: LIB150-028-Q1-E1-C6
agncgtccgcccacgcgtccggacccaccccagacttaaggtgttacttcgtgaaatcggttatatg

SEQ ID NO: 6318 - DNA, 387 bp, Diabrotica virgifera
  Clone ID: LIB150-028-Q1-E1-D1
cccacccgtccaggatgccacattcaaaggcttccacggaacttatcgggaatataactgctcctaaggagaaattcaaacccgacagatatcagaggatataggagtacttgggccaaacatcatggcgtttgcagcttagaactaaacactgacactgatgaattatatgcatagaacgttgaagaagaaatcgtacaattctttatcagaaacgaagtaattccagtcaactagcaccatcttgaaagtccggtcctttccctgcgtgtgctttgtcacaacacattcatgcagatttacagtgacaacgttagatattataatacaaataatatgtgtagtttgcacattgacatatctatttgctaatcaagtgtctccttc

SEQ ID NO: 6319 - DNA, 221 bp, Diabrotica virgifera
  Clone ID: LIB150-028-Q1-E1-D12
caacaattgaaagttgttccccaacaattagtcaaccaactcgtgttcaacacacaagaccgtatgtggcaaactcaaggaacttaccaaagagtaccacttatgatgcaaagaacttaccaaagagtaccactcatgatgtaaagactggtttatttttaatatgttgtttaaaatatttgttatgattgctacaaataaataaatattttttgtatatt

SEQ ID NO: 6320 - DNA, 419 bp, Diabrotica virgifera
  Clone ID: LIB150-028-Q1-E1-D5
aatttatataagtatgtctgaagcacgggaagtaaaattgactttatcccagttatttatgtggttgcaaggccggcagagatctttggttgagggtgaggcagtttttgatgctggtcacataatattttgcaaactaaaaaagcaagatgccctggaagtggttgcattatgtgtgcaaacatccagcataaacactctgcctcatgaaatatcgataaaaattccgtgtgaagaagatttaacaacatggagctgtaagtgttcatgcaaggctggtgaatcgggatgctgtaaacatgtggtggcaactttaatttacataaatcggaagagcaaattagaattctgtagcccaactgaactggagcaagcttggggcgttaataagcccctgataaaagaaacctatcaaaggg

SEQ ID NO: 6321 - DNA, 323 bp, Diabrotica virgifera
  Clone ID: LIB150-028-Q1-E1-D6
acagacacgtgggacgtcttttcacaacatatctaactttgtgactatttatgggaacatttgatgctctaaccataatctatataaatattgacgttaattactatctattgatacgtatgctgttatacagtacagtgagaaagcacatgaggaccatattcgacatagtatccggggctgaaatactccctatcaacatgaggatatcccaggacgacaagcctagttatgatcacaaatgcagatatgcacatcattcatataaccctccgagtcagtacagtgttactggaggagaatataatcatatatacgttttg

SEQ ID NO: 6322 - DNA, 407 bp, Diabrotica virgifera
  Clone ID: LIB150-028-Q1-E1-E12
gaataatcaaactaaaatagcgctttactacaaggcatcctggttttaggccttctcctacttttgctgttaccctttttttaactgaagctaaagaaagcggtggaatggttactggtctctactaattaaagaagaatcaacagccatggacaaaacggtcaaaagcaggggatggcctttaacaggtgctaagtgtaacatcaaaccattactatttgatctcgaggaagcactttctgtagagaacacctacaggcccagtgtattagcaattcaatataacgttaaaccaggagaagttactctcaagtccagggatggtattgtacatcttcttcgtttcctgaagtcttggtttgataccccagaacaagtcttttttgtagccgtcggctatctggatg

SEQ ID NO: 6323 - DNA, 377 bp, Diabrotica virgifera
  Clone ID: LIB150-028-Q1-E1-E2
gtccaaatgctccatccagaactctgcagattgatgaatctaggaacggccaccaacttggctattccaccctccaaagtgtctacaacgatcgtgtcaatcatactgatgttcttgctgatcatttcagtcactatgacggtattgtctatgaccataccttctacagtttgttgatcacacttcaacattcggtacacgctggagtcatcaacagattagtcttggatgttgtcataaactgcgatcagcaaggtgtacaaggtgttagtgacattgtctctctgcaaggactctctggttatggcaacttccaaagatcaacaacagtatattccccactcaatgagatcgtaaagaatagactacaaggaaag

SEQ ID NO: 6324 - DNA, 355 bp, Diabrotica virgifera
  Clone ID: LIB150-028-Q1-E1-E5
gcgtccacaagcaggtttaggccaggcattgtaccatttgtgaaaaacttgctttcttagactcaaatggtacaatgcctggcctaagaaagcaggtttttcagagataattttagaattattgctttagatatcgctcagttttacctcgagcgtcaacaagatattgcgggagtggtgcttatagtgaaaattacacagattctgcataaatgacacttttagcgcgaatgagattaagttttaggccaggcgttcagcacatgttttagagttgagtcgctgaacgagtttttccatcatattctggagtgagtggatatgagagtgaggaattttgctaagtttttgtacg

SEQ ID NO: 6325 - DNA, 305 bp, Diabrotica virgifera
  Clone ID: LIB150-028-Q1-E1-F10
agctggagcagctggtccctctggagtcgtaactggagctggcgctgtaggacccgctggagtagtcaacggacacggagccgtaggaccaactggtcccaatggacacggtgctatccttgcccctgctgccttaggtttgggattgggattgggacatgccggtttaggtcttggacttggcggatggggacatggagctggacatttgggtcttcatggttgataacaaatagcatttcctaggaaataaacttttattgatttttgcaatgaactgagattatttatattaaaaagaaaaa

SEQ ID NO: 6326 - DNA, 390 bp, Diabrotica virgifera
  Clone ID: LIB150-028-Q1-E1-F11
agtccagccagaccaaaccactgagatagatattgaggataatcttgaacaaagcgtgttgaaagtaagcaacaacagttacgaacaggaagtatcattttctgctaaaggtggtcacgttattgacgacttggaaaacaacatggaagaacttcttgactcaaacgaaacagaaactgaaatggtcgttctggaaaacttttctttaagcccaagaactgctgtcactgttttgagtcaaaatgttgaaggaagcaatgaacatcctggaaagtatactgtaactaaccttggtaaagctgctttcgatattgagttgaagcgtacctcacccgttcaaactctagagctccatcgcaaaaccgttcagcctaatacatctgaatcctt

SEQ ID NO: 6327 - DNA, 409 bp, Diabrotica virgifera
  Clone ID: LIB150-028-Q1-E1-F12
acccacgcgtccgcatcatggtaaacaaatagacttgtgagagatgcaataagtttttaaagtattatttttaataagcatttgagttttgaaccgaatttataagtttttatgaacaataaataaaattttacatcaaatatggtagataatcctgaagcttccagtacaccaaaaaaagtaatgggaagaaaatctattcgaaattatcaagttgtgagtcctattgaaaatcaaaaaaatatatcacaaacagatcattacaatgataaagttcaaagagaagatgcaagggaatgctttagttctggaacggagtcatattcagatggtgaaggacaagtagattccgctgaggaaaatagcctaaatcctgaaccgaatgtgagcaaaactcaatttagtgtca

SEQ ID NO: 6328 - DNA, 360 bp, Diabrotica virgifera
  unsure (1)..(360): unsure at all n locations
  Clone ID: LIB150-028-Q1-E1-F2
ataagaagaaggcagaatctgaggaagaggaggaggaggaagaagaagaggaggaagaggaaccttctgaagatgagaaaaagaaaaaacgcgcctccactggtaagaagccagcagcaaagaaggcaaagaaaacatcagaagatgaatctgccagcgaacagagcgatggcgattctgaagaagaatattcacccaaaaaggcaaaaccagtcaagacacgcaaacttccccccaagaagaagaagggttccgaatctgactcagatgaagactggggcaaaaagaagggaaagaagggtggcggcggaggcaagaaaggaggtancggttacacaaaagtaatgaacttatctccag

SEQ ID NO: 6329 - DNA, 374 bp, Diabrotica virgifera
  Clone ID: LIB150-028-Q1-E1-F5
cataaacagagcagtacctgttcctgtacctcaaccttatccagttactgtcaatagaccagttccagttccagtaccacaacctgtcgaagttccagtccccagaccagttcaagttccagttccagttgctcaacctgttgaagttcccagaccgtaccctgttgtagtaaatcgtccagtacctgtagccgttccgactccagtacgtgtaccagttccacaacccgttgctgttccagtgccacaaccttatccagttacagtaccacaacctgttccagttagggtaccccaaactattgtagtaccagttgctcaacccattgttgttggaggcggtggtggtggacttggaggtggacttggaagtg

SEQ ID NO: 6330 - DNA, 342 bp, Diabrotica virgifera
  Clone ID: LIB150-028-Q1-E1-G1
cacacgcgtatgctaagacgtccgggagacactagcatcttggacacgtatggcagatacagaaaacatggtcaagaagaagaagaacgaagacggcgacgcagcagctgccgctcctgcccccgccgaaacgaggtcctcctcatagagttcctcgaagaaagccaaagcgtctggttccaatgtcatctccatgtctcctgaatctcaagtagctgagttcaaagaagctttccaacttatggatcacgacagtgatggtaacagctctaatagcgatgtgagggccaccttcgatgctgtagggtcactcgccagtgacaatgagctcgacgagatgat

SEQ ID NO: 6331 - DNA, 375 bp, Diabrotica virgifera
  Clone ID: LIB150-028-Q1-E1-G3
aaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaattgtatatttagtaaaaatatataggtttaataaaggaattcggcaacatttttttcacctgtttattagaaacatgtccttttgt

SEQ ID NO: 6332 - DNA, 199 bp, Diabrotica virgifera
  Clone ID: LIB150-028-Q1-E1-G4
acacgtgtcggtgaaatcggtgctgttatagtaaaaaacaagcacaatggctcccaaacgtaataatatgattccaaatggccatttccacaaggattggcaacgattcgtcaagacttggtttaaccagcctgcccgtaaaattcgcagaaggaataatcgtattaagaaggctcgtgctattgcccctaggcctgct

SEQ ID NO: 6333 - DNA, 372 bp, Diabrotica virgifera
  Clone ID: LIB150-028-Q1-E1-G6
atgatttcaacgaaatcaatatacctatcaactttaaacagtttttgaagatattcttctttagcggcgattcgattgagggtaaaattgtacatatatctgcgcgcctgcgcacacagacagcatgtagttcattgctaatctttcaagataggtatgtatgtatctgtaaccgtgcaaacaagtcattaaaagaatgtattagtgtttttggtaaatgtattatttgttataattcttgtgtttttggatttgtgtttctctgtagtaaaataatgaaatattatgtaggcataacatttttacactatttgtcgccgtgttgtgtaattatatccgaaacttacacgtcaattacaaggacctcgctgg

SEQ ID NO: 6334 - DNA, 381 bp, Diabrotica virgifera
  Clone ID: LIB150-028-Q1-E1-G7
aacgaataacatttcatttttaaatatatctaattttttaagaaataaattaaatttatttattaacaatatatttaattataaatatattgttaataaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttt

SEQ ID NO: 6335 - DNA, 379 bp, Diabrotica virgifera
  Clone ID: LIB150-028-Q1-E1-G8
gccggccttgtgatgggggaagaagaatctacaccgatgttcttgccaggtgagtcgactataaccgaagaaggacagttgaaattcgaatcgaccgaagaagaccgaccgagacgacgacgtcttccctctgatagcccccctccaccacccaaaccaaagccaagacctaaagttgaggaggagatcgtcattcgtagacgtgttactgatgaaccaaccgagccactaattaaagagagagttaagaagcgtgcgccagttattgagctcaagagacccgactctccacctagggaaattagaaaagtcagagaacctatggaagaccctctcaaactaatggaagaacagaggagaaaacgagaagaagaagaaa

SEQ ID NO: 6336 - DNA, 352 bp, Diabrotica virgifera
  Clone ID: LIB150-028-Q1-E1-H1
atttatatatatatctaattttttatgaaataaattgtaatttatttattaacattaatgttagaattaaatattgttatgagaataatataatatatttttagggatttaattttttgtaccatgttattcaaggattatttttataataattatatgattaataatttccatattttaagatctgttattatataatttttaatgttaataatatatatttttaaatattttgtaatgaaatgtaaattcaaattatttatatctaatatttgaagataatattagtattataataatgtacatttaatatatatatatatgtttataaaaggaaatcagcaacaatttt

SEQ ID NO: 6337 - DNA, 401 bp, Diabrotica virgifera
  Clone ID: LIB150-028-Q1-E1-H10
gatttttaactagaacaaaagtttctataggagaaacactaggaaaaagattttttacgtcgaatgaaattagtctggagttgttgcgcaattgaaaatgttgtattttattaactaattctagtatattttttacggtgaatttaggtgaaaaatttagtgtattctgtaataatatctgacagtttttttgaaagtttatatgacagagctatataaaaagaaactacagatcttattgggtggtcacacagatctgtatctacgttgtaatcgatcgggcggtcagcgtgtactgaatgatttcccagcacagactgccaaccctcctgacttgttttcaagccgcgtgcacgtggcggcgtagcagaaactatcgtgttctcagtgcactccgcggg

SEQ ID NO: 6338 - DNA, 423 bp, Diabrotica virgifera
  Clone ID: LIB150-028-Q1-E1-H12
gggccgatacaagcgtctacatagatgcaccattaatattaaatactattgattattgaaatggagtctgaaaattttctaataacagattataaaaaagtctggactcattttggaaaaactgaggaaactgttgataaagatgtaaaaattataaaaaactggataaaatctaatcattattttcctgaaataccagatgatattatgatccaacactttctgaccaactgcaactttagtattgaaagaacaaaacagtgcttggacatgtattatgcagttagaattgttgtaccggagatgtacaattacaccaatccaacatcaagttacatggctgcagcttacgaacttatcttatgttgccctttgccacgtctaaccgaccaattggagagaatattgtttctaaaactaaat

SEQ ID NO: 6339 - DNA, 399 bp, Diabrotica virgifera
  Clone ID: LIB150-028-Q1-E1-H2
tcgacccgcccgtccgcatatataaatatttgtatatatgtatgtatatatatatatgtgtgtatatatatatattattgtgtttgcaatttatcaatcaaaagcaaaataaaaattaaattaaatttttttttaataacgcgggcacataaatttgatacacccggtatattgagctgttttaaaatttatttgaatttagttaggatgtaaatagatttctcttttaacgagctttccgcggaaccattaaagacttttgtgaataattaaagtgaaaaggactatgtatttagatttaaaatggaaaaaaattgtttactgtataggtaattataaatatttctcgaaattgataattgaaaagaaagttggaattttaatatcttcatttcaata

SEQ ID NO: 6340 - DNA, 58 bp, Diabrotica virgifera
  Clone ID: LIB150-028-Q1-E1-H3
cgcgtaggacattacgaccccctaaagtgagtcatattagtagagaagtatatacaca

SEQ ID NO: 6341 - DNA, 333 bp, Diabrotica virgifera
  Clone ID: LIB150-028-Q1-E1-H9
atctacctttattatagctgaaactattattactataagattgtcactttggtaaagatatattacgttcaattgaggatctccggaacatgtttcttcacctgatcatgatgtacatgatctaactgtatcaactatattttctcgcctgaccacaggttaatttgttagggcgctgtattttaaccgtgcacaggtatcataatcattaatatttttaatctatgctggaataaacggttgatcttattgggtgctgacattaatcagtttctacatagttttcgatttaactgacaacgcgtacagttttttatcccacgagaagatgct

SEQ ID NO: 6342 - DNA, 458 bp, Diabrotica virgifera
  unsure (1)..(458): unsure at all n locations
  Clone ID: LIB150-029-Q1-E1-A11
gcccctttcgtcacaggaagctacgtacaatcgggcaacgtagtaattttatttcatcaataagccataatatccaaaaatgggtgataaaattgaaatgagtttgggcgacataatcaaatcaaaccgaacacaacgagtccgaagaagcaaaagggggcggaagaaggccgtggaggaaggcgtaatatgagcaaccgttggggttggcaacgcccttggaggaaatttcaaaaagttcaggtcgtcccggtggnaaatgtgcaaagaagtcgtgggcgatgcggcatatctcgcaatacacgcgggtaactacatttagtacttaattttaatattttttatatattttgaggctcgggctggaatgtcgtggagtcttcttaanatacaccagaagctatagatgctgaccaattgtttctttaaggagacgtanacagtgcatggaagcatga

SEQ ID NO: 6343 - DNA, 413 bp, Diabrotica virgifera
  Clone ID: LIB150-029-Q1-E1-A3
cgaggtagacgctacggtgtcgagtgtagttttctcctttcttgatcttttacttctgtttcgagctttccgtagctagataatgtgatgcctagatatttgaactccatcactttctctattatttgaccctccagctctatttacatcttagtagatttgctcttataaccatgaattttgttttttttttttttggagaaagtaatgtgataaattttctagcggttatattgaattggtgcagggtgcagcatatatacattgtaaatcatcttcaatttgagagataaaaactctgcggttaccacagcaggacccaagcccgcataaaatgtggagggtgattggcaaggttagtactactcaaataaacatgtgaagcctttgaaagtactaaaacatgaaatcgg

SEQ ID NO: 6344 - DNA, 415 bp, Diabrotica virgifera
  Clone ID: LIB150-029-Q1-E1-A4
aaaaaatctgtaactgtcagaacaggaatcatgtgtgacacagttattaaaataccagttgtgatatctattatattaataaatagctcacctattaacaaagctaactaattataaaattgcgtaagtaaaatgttgttatacgtaattaaagatcgttattgagaaattcacacctagaatgcagtactgataagatacggcaatgcatttcctaagggggaataaacgcacacggttgtcggtcatcactggatgttgattgctctctcaagagcgtcgcagaagaactgtgtcaacactgaatgcgcattcaaagattaaccgtactgccaaattgatataagtccctacgaagaccttttatatgaaacagatggtcacgtttataaacaagcttggatgacatggatgt

SEQ ID NO: 6345 - DNA, 299 bp, Diabrotica virgifera
  Clone ID: LIB150-029-Q1-E1-A6
acgcctctaggcagagtcgtattattattttctgttgtagcagcgttcgcgaaattgtccatcaggcaggtgttgccgactacataggtaacctaatcaacttttcactaaggccggtatcacaggagtaccaagcaccacgcagaagactttccaaacgttcacattacgtggtgtggatccacatcatctttgggcgacgccatatgatcacctcatggtacgcatgcttaggagttccagtgtgcggtgttacaaagggattgtaacggataccacaggtcctactgtaaacacta

SEQ ID NO: 6346 - DNA, 361 bp, Diabrotica virgifera
  Clone ID: LIB150-029-Q1-E1-B10
aagcctctacagagagtcgtattaacgcgtggcggacgcgtgggtttttcttgtccaagggtgcaattttcatttcgtcatcatcacttggtttcacaatgtttcctaaggccctcatgaatctaatgagtcaccaagttttattgagcgtatccagcggcaaaatttggtacgtttactgcttcattgattcgcctaatagcttgaatttgtgacgttcttaatacagtttcgaaagacgtatgacatgcttacaaagtagtcggaacgaatataaccgtaagtctctttaaaatgcattatatgatttccgagattctagactaaatttttgactgtagttgaatcatgtctgaaatgc

SEQ ID NO: 6347 - DNA, 320 bp, Diabrotica virgifera
  Clone ID: LIB150-029-Q1-E1-B12
gcgggtggtcgcaagagtctggagtgagtcggactaattaacgtctgacaaaaagaaacaccattggttaaaataatttcaatacaccttcctttattgaagctcttactctgttcagggatgaatttcgttagggaggggaattgtgtgatcgtaggcctttgtttccgggaggtttaggttgttgggctgggaagtcttctattgtcgatcttgatggggatgttagtaggaggttcggaagatggacctattcctgatcttgtgtagtgtaagaggttaggggttttttgtaagtttttgtatgttaagttatatga

SEQ ID NO: 6348 - DNA, 420 bp, Diabrotica virgifera
  Clone ID: LIB150-029-Q1-E1-B4
cccacgcgaccgcccacgcgtccggaagaaagatgagaagaacgaagatccagacactgcttatatagaaacaaaagaagatccaatggctggagatattggtgagttcacagctattgatgaaattaaagaggaagaagaagataaggcggtgccagctgcaaatgcttaagtgatccattcaattttaagcagttcaataaacaaaaattaatagttagaaaacaggacattacaatttttcgagtttaaccatttcaattttaattcatattatgagtcagccatcattcatcgtcatattttttactataatttaattctacatttcaaggtcattcatacctatggttgaggagtaaacctcgaaataaaaaaaatccccattactacggtgtaggtaatcgtgctaaaagtatg

SEQ ID NO: 6349 - DNA, 471 bp, Diabrotica virgifera
  Clone ID: LIB150-029-Q1-E1-B5
aattaaaagtgtggagcgtcattttttaaacaattattcgttaataatgaaatttcatgtaagttgacgtattcgtggaacttggttgtgaagtttcattgacagttttaagtttcatcctgctgaaacttcgatatttaaaatgttttaggagatatgtaaatcgttaaatttatatttcacattatcacacaaccgtcatacttttcgcaacaagtaatttaagccataaaaaccaaatgtagtcatatagtttagtgatcgaaacaatatgattacatatattcatttctgtgattgttgtgtgattcaatgtcaattcttctgcatcaacttttgtttttttttatatatatattcagtactgtaatggtttttaattttttatatattaaatgtatatttatctccttctagaattttgaaaatttttttttgaaattttagcaccttttaagttgtaacttgtta

SEQ ID NO: 6350 - DNA, 111 bp, Diabrotica virgifera
  Clone ID: LIB150-029-Q1-E1-B8
atacgatgtataaaacacattcatttagtaagaatatcgaattatgagttgtatatattgtattgtacatttttataatcaaggaacatgtaaatatataaaatgccgagt

SEQ ID NO: 6351 - DNA, 171 bp, Diabrotica virgifera
  Clone ID: LIB150-029-Q1-E1-B9
catgttatggctcgtgtaactcaatattatcctgaccgttaaccatcatgtacgccagcagtatcccgtccttgctaaggagcaggtcgcccaagatgcccaggacgtcgggagtcggtcgtccagcttgtaggccagtgataggaacaggctatcttcctgctcaaagtt

SEQ ID NO: 6352 - DNA, 462 bp, Diabrotica virgifera
  Clone ID: LIB150-029-Q1-E1-C10
caatactctatagaaagtcgtattagtgtaagtatgtacacattttgttgtgatgttgatttggtcgtgctgttgattgtataggcatgtaccatttcatacatcatagtgtatttaacttgtaaccccatatgtatactggtattgtattgtattgtaagtatcgtagaacagaattgtatgttattgtagcgtactaactgtattgtattgatattgtacccatgatgaaagcattgatttgaatttttttgaaaatattgatgaaatatatagacaaacagttgaataaaaaagtaacgtaaaatttttttgaaaattttgattaaaagtaacgttaaatattttgaatattgaatccaattatgaagtataacagtatgttgtattttttgcatgtattcctatagatcaacagtttttttacagaataatcgttttttgtgatttaatgatttggtc

SEQ ID NO: 6353 - DNA, 471 bp, Diabrotica virgifera
  Clone ID: LIB150-029-Q1-E1-C12
acaacaccctatagagagtcgtattattctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactgggatcagcaaggtgtacaacgtgttagtgacattgt

SEQ ID NO: 6354 - DNA, 401 bp, Diabrotica virgifera
  Clone ID: LIB150-029-Q1-E1-C2
atgaataataatgaggttaatttttggtgggaaaatcatcacacacattgacacacatgagatcatgatatgaaacgtctaacaaacaaactgttttactgttttgttatttgttgacgtgtctagaatctgaaactcgttaaattagcacataatacttcatcggaaaagtcttaattatggcatagagactggaagatttaaatttacctaataatacagtacagataattatgtaatgaggcacttcctgattctgtgaatatctgaaaagatgcaagatctgctttgtccagagctgcatcagtgtatgttttatatgttacttctcaagcatctaatgaagcccattttaatagcagacagacgttaatggccggcgacgttttaaagggcataca

SEQ ID NO: 6355 - DNA, 448 bp, Diabrotica virgifera
  Clone ID: LIB150-029-Q1-E1-C6
ctcaaatctatcgacgctcccgctattcgtaaaaaggccgcattttaccggctttttttgctatcgttttataccgctcagataattcaatctgctcagtattatcgacgatgatttatttagcgtattagtgagtgccttacaaatgaaccaaatggattatggaattcaatcagagctctgatgtgacacgtcatcaaggaataaaactgtaagtactctacatgtatgtgaacataacttattagtcgtgatactgtatgcattttgaaccatatacctctcgtagcaaatattctttgtgccatttatgcagataatactttaaattacatatgaaaaatcgttatctactcttaaccagcttacctatgggaatatactctataaccgtacaataagtataggttactattgttaaggatactttacgtattgcctaaacaga

SEQ ID NO: 6356 - DNA, 472 bp, Diabrotica virgifera
  Clone ID: LIB150-029-Q1-E1-C8
gcgggtcgacacaagcctctaattagaggcatgatatctcaacgttaattcttaatctttctcttcttcttatacttattgtagatctgtcgatctgttaattccgactttgaagtatttcttgagaggtaaacttccagctatctctccatctttttggtggtctccccggtggatgcttgccagctagttttccttctagcgcaatccttggtagtctgtgctcctccattctttttacatgactgaaccattctcttcgtctttgcctaccccatcttactacatgttgcacgccacattgttccctgagcccatcgtttcctaaaatctttccctgacttctcccataatatgtgggcatcaagagttttatatttcactaaatgaaaagattttaaagcattttattttttttaattgctcacatcaaattgtgccacaaagacgccatatttctaaaaacgaactg

SEQ ID NO: 6357 - DNA, 440 bp, Diabrotica virgifera
  Clone ID: LIB150-029-Q1-E1-D10
cttagattagttagatttttaaattgtatctcttaattttgtttaaatctattataaatcggttaagttgcgaataattcgcaacttagtagtgacatctttaatacttaattgttatatcttttttatttaaaaaaataaataaataaaatataaattaattttgcaattttatttaaagataaaaaattacagagggatttagaaagttaatcgcagctaagaaagccgagttttacttcaaaaagtctattctattttgccattgtttttcacgaaatttgttataacttaggttctgacaatcggaataaaatttggcaaacgccattttgttgattttttcaaaataaacagttttcacgttaataaaattactaacagtttaggatgttcaataatttaaacaattaaactgttaatggcgaattgtgtgacgt

SEQ ID NO: 6358 - DNA, 448 bp, Diabrotica virgifera
  unsure (1)..(448): unsure at all n locations
  Clone ID: LIB150-029-Q1-E1-D11
gataaagtgtcaagatcttctttctctagtaacccttagtgtaactgcctaagacccaagtactggtaagcatgtgacaataagagtaactgggaatgtgaaactaatccggtcccaagggtcccaaattgcaattcgaaagccttaaaaccaagaactggtcgacgttaaccctcaaaaagtcaagatgctcaaaccagaactctgcaaattgatgaagccaggaacggccaacaacttggctattccaacctccaaggtgtcaacanacaaggtgtcaaccaggctgatgttcttgctgatcttttcagtcaatatgagggtattgtagatgaccagaccttctacagtttgttgaacatacttcaacatttggtacaagctggagtcatcaacagagtagtcttggatgttgtaagaaactgggatcagcaaggtgtacaacgtg

SEQ ID NO: 6359 - DNA, 466 bp, Diabrotica virgifera
  unsure (1)..(466): unsure at all n locations
  Clone ID: LIB150-029-Q1-E1-D3
cccacgcgtccgcccacgcgtccgcggcaattggttaatgatgttcaattccaaccaaaagttaattttttggcaagggaatttctgtcagtccatgtatcatgctatggtaggcttctaatttgtgttgtgtaggatgggatgatgaattgtgtaaagttatatcaggggtatgtttatcangggtcagttatatgggtatgtttatgatatacggagaactcatgtttgttgtgtagtctggtaattgttacatctagaaagtttatggacttattctgttctggttctattgttaactcaatattactatgaagtgaattaatgtatgatagaaattggtcaagttgcctgttagttcctgtaaagcatactagtatatcatccacatatctccaccaatataagaactgtttaaatacgggatgtttagaaattgtttcaagctggttcatgaattatgaat

SEQ ID NO: 6360 - DNA, 360 bp, Diabrotica virgifera
  Clone ID: LIB150-029-Q1-E1-D6
agcccacgcgtccgcccacgcgtccgcatctcctcaatacggagtacccagctaccaataccgcgtcgttggaatcgatctagagggaatcaaacaagccatccaagttgcccagtacaaccaaatctcacagggaccaagctttggaggataccccagcggacctagttcgataccatccgggtcttacggagccccttactaaggctctagaactgatttcagtgtgaataccatcttttaccatctcagacgggtcatgatgcattcaataccatcaagtttcaaccataccatcaaaagttgaatgtttgtataaagctttcgtaggttatttaaaaaaaatacatttgtcaccgt

SEQ ID NO: 6361 - DNA, 435 bp, Diabrotica virgifera
  Clone ID: LIB150-029-Q1-E1-D7
cttaaatatcaatggccgtattatttacattatactagaagagtagttttgacttggttctgcaaccgtagaaatccaagatccatagttttttttagcgattttgtgccactagttgtattagccataccataacttaaatccgtcccaccttttccttgtaagcttgtagataaccaaaccctaactttgaaattactgtaccctaattaaactaaggaaacatttcctcgcatcgtctagtaggtgattgaacataatgaatatatatacagtaacagccacgttagtaggcacacgggtacattgagctaataaatgtacctactccgctaagagtcctggaccctgcacttgttgcactgtttacttttatgtctagctagtgacgtctcaaacgtcagaaaatgtatagaaaccataggccattccaac

SEQ ID NO: 6362 - DNA, 196 bp, Diabrotica virgifera
  Clone ID: LIB150-029-Q1-E1-D8
actccctatagagagtcgtattaacgtgtccgcttcatttcaatacggggttcgttttgaccatggatctgtaatcgtagttgtatctagatgaaatcattctttccgcgcttgtgtcccattacaggggatttctcatacggatcaatctttcggtgatagcccagccctgttagcttgatgccttcctagtctt

SEQ ID NO: 6363 - DNA, 477 bp, Diabrotica virgifera
  unsure (1)..(477): unsure at all n locations
  Clone ID: LIB150-029-Q1-E1-E11
tgctcatattcttggtatgacgttttttatcacgggttattttttcgtgtgttgcgctcatcgacanaccacatgaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcaggatcctcctctgaaaacaagcgatgagttcgggaaaaagaaatccacctccgaattctcctccaaccaaaaaggatccagcgaagtaaaaatccaagaaaagaaacttgccgaacctctcccagctatcaaagaaccaatttaaggaaaaatgaggccaatcgattcacttcctngttttgaaaccatct

SEQ ID NO: 6364 - DNA, 384 bp, Diabrotica virgifera
  unsure (1)..(384): unsure at all n locations
  Clone ID: LIB150-029-Q1-E1-E12
gaggacactgatcgatgttggcacaacggattatattttatattaacgcattgcagtcatttgaattaccgacagtccattagcactctgagagaacaccatagttctcaaacgtaaatatccatattatgtaccttgtgtctcaaggactattagttaataattattccactattatattcgaacttattagagctgtaacattataatttttatcgttcctttaatactctgaataatttttttgtgcagacatgtgattcacttttaaatatagctgtctttttgcgtaatctctcaactgtaaatattaacatgagacctataataatataccagtatattaantatatcacataatatttagggatgatcttaagttta

SEQ ID NO: 6365 - DNA, 441 bp, Diabrotica virgifera
  Clone ID: LIB150-029-Q1-E1-E3
cacgaaaacacttccggaaaattaagaatgaaacctttgataacgctctggttcttagtccttgtagcagtggcgataaacgccgaggccaaggagaagaaaagcgcagaagccgatgacaagaaacagaagaaacgtggcctcctcagcttaggatacggatatggtggagattttgataatggttaccacttaggacaaggtggatacggtattgacggtggttacacactaggattaggccacctagacttaggacacactacttctattgagaagaccattactttggttaaaggagtaccagtaccatacccagtagagagacacatcccttacccagttaccaaacacgtaccttacccagtaaaggttcttgtaccacaaccatacccagtagagaaaccagtagcctacccagttaaagtacatgttaaagta

SEQ ID NO: 6366 - DNA, 129 bp, Diabrotica virgifera
  Clone ID: LIB150-029-Q1-E1-E6
gggtcgaccacgcgtcaggaaaggatcaaatatataaaataatttttaatatttatctaaatataaaaattattttatatatttggtcctttcgtactaaaatatataaaataatttttatatttagat

SEQ ID NO: 6367 - DNA, 471 bp, Diabrotica virgifera
  Clone ID: LIB150-029-Q1-E1-E8
ctaattcactaaagtattgttattagtgttaaatataaaggacaatggccgatccactaagtttgttgcgtcaatataacgtaaataaaaaggaaattatcgaaagagatggacaaatcatctttggagagttttcttggcctaaaaatgttaagaccaactatcttatttgggggtcaggaaaagatggaacaccgaaggaatattacacattagaatgtctattgttcttcttaaaaaatattacattaagccatcctgtctatgtacgacaaacagctgcagagaccatacctgtcgtaagaagacctgatcgtaaagagctattggcttatttaaatggagaaactgctagttgccctgccattgataaaagtgctcctttggaaatacccacgcaagttaaaagatctgctgattatgacggtccaaagagtctggctaaaaagccgaggttcgaagacacacatg

SEQ ID NO: 6368 - DNA, 467 bp, Diabrotica virgifera
  unsure (1)..(467): unsure at all n locations
  Clone ID: LIB150-029-Q1-E1-E9
aataaaagtgtcattagacctaatacccgttgtaaccatcactttagcatacttttccgattttcggaatatcgagagcacctaataagttacacagtatttgttatattgtcacaaagcttaaatatctatttgtaagttatttagaccttgaaaatttttggtcactggtaaagttcatttttcaactgacgcaagtgttatctctgggtgttgtcgttaaactggttgcctactaanaacaagaaagaaatgaaagagtcctctaaaatgattatgatttattgtctccccttgtaccaattctagtgatatttaacagaaaaatcgcgtgtaaactgtagtttttattagcgaatgcacggtgttgtttaatttatagtatttaaaaaagtgtcaccctattattaaatttaacttataagattatttgtttgtcgggaaaaatatcaacanaataatataaa

SEQ ID NO: 6369 - DNA, 442 bp, Diabrotica virgifera
  Clone ID: LIB150-029-Q1-E1-F12
gtaagaaactgggatcagcaaggtgtacaaggtgttagtgacattgtctctctgcaaggactctctggttatggcaacttccaaggacaatcaagagtatattccccactcaaagagatcttaaagaatagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattggtaccaaccaaatcttaaacctcatctacagacaacaacaacaacttggacaaggcagaccagtaccactaaaccaataccaagacattgataccaaccaaatcttaaacctcatctacaaacaacaacttggac

SEQ ID NO: 6370 - DNA, 270 bp, Diabrotica virgifera
  Clone ID: LIB150-029-Q1-E1-F3
tgcaataaacccttagtactccttaaggcgaaatatcaaaataggaatattaatattaaagtcactcccgtaaacctaacacgctctaacactggctttgccaagactatgtccgaagctttagaagaatctttaagtgcagatactcaggattcagtcgaggctcccagacacgctttcacagaagtagctagcttaaatgcagaggatcctagttttcatcctcaaaacaaatcggcaatgagttgattaaagatgatatgttaattt

SEQ ID NO: 6371 - DNA, 331 bp, Diabrotica virgifera
  Clone ID: LIB150-029-Q1-E1-F4
cgaagtttacgaataatgtaggtcttcaattgaccatattaatgccactttaggagaagacagacaattaattgaccaaatacaaagtgaagataccaggatcaacagtgttattgataatttaaggaaagaaatctgaggccacaaggattcgaattcaaaacttgaaagcctcataacagaaaagagttttgcgtgtgaagctaaaggcaagcaaaaccgtgagcttaatgatgaattgcagaaaataggtactgaattgttacaaatcgttaaaatacaagaagatctgattctcgaattaaagaaatcaactgaaaaagcctccttt

SEQ ID NO: 6372 - DNA, 465 bp, Diabrotica virgifera
  Clone ID: LIB150-029-Q1-E1-F6
cccacgcttcagaaaatgtagatacattaaacataaatatgggtaatagaggaagtctggaacatttttcacacctgtttataaaacacatatcattatgtatgaccgatatagtcacgcctgcccactgattaaattgagtggccgcggcagctcaaccatgcaaaagtagcataatcataagtatacctattgaaagctgtaatgaagggttgggtgatgtacccactgtcattagtgaacttataaagaaatttcactctaagttataatacataaatttgattacaacaccagtcacccctataaagattaataagattgataataaatttgtggattagtacctttagataaataaaaccgccactgacatgaggtgatgaccatggaagtccatcattatatatagcaatatataaattacaaatatcttgatccacttcaattgaatgtgcaaataaa

SEQ ID NO: 6373 - DNA, 425 bp, Diabrotica virgifera
  Clone ID: LIB150-029-Q1-E1-F7
cccacgcgtccgctcgtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatc

SEQ ID NO: 6374 - DNA, 467 bp, Diabrotica virgifera
  unsure (1)..(467): unsure at all n locations
  Clone ID: LIB150-029-Q1-E1-F8
aggacaacattcacatatttcacgtaaataaattcataatgaatactccaatttcagcgttttcagtttatagaaaaaagccaaatccaaaaatagttaaaagacagatcgttgtaaaaaaacaggttaaaaagaaaatgactatttctttaaaaaaatgcgtgaataaaatcaagcagaaaaataccaatcctaatccacaaaaattgaaggacactgtaaaaccaagagctgtgataacacataatctaaatcaaaactttaagaaggtagataataaaataaagaaaaccacatctccactaagcacaaaacttaaaaaaggtacggtatttcacaataaagatccagtttcggaaagtttaaaattatttaaatggttaattgcacctctaagtccaaccaagttttttgaacagtactgggaagttaaagcnctacacatacaacataattcaactcactac

SEQ ID NO: 6375 - DNA, 479 bp, Diabrotica virgifera
  unsure (1)..(479): unsure at all n locations
  Clone ID: LIB150-029-Q1-E1-G11
gcgggtcgacacaagcctctagagtgagtcgtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcaaagagccaattaacgaanaagtgaggccaatcgattcacttcntgttttg

SEQ ID NO: 6376 - DNA, 376 bp, Diabrotica virgifera
  Clone ID: LIB150-029-Q1-E1-G12
atagtgagtcgtattaaatgctgcgcgaaggttggggctgttgttgcagtgcttttagctgtttgagttgtctatcgtacaacatcgctatttcaatcacgcaaggtgtcagggttgggcgaaaaatggtggtcagtggccgcgccggcaagagtgggtactagtagcaggccgttcatgattcaaatttcagagtgagattttaaaagacttgaacgacagactatatcggtgtcttccatttcaggcatccctagatggcgtgaaacaacattacagaatgaacactaatctcctgactacgaaagtggactattggcagaacacatgtgacgggtgacaaagggaagggtttttcaaccagtatccacagttt

SEQ ID NO: 6377 - DNA, 467 bp, Diabrotica virgifera
  unsure (1)..(467): unsure at all n locations
  Clone ID: LIB150-029-Q1-E1-G4
agcaactttaacgaaccgactatgacaagtgacggttttgtaaaatgcttcctttgtttttatttcgtttcaagtgttctagttataagtcatggatatactataagtgtaaatgaaaattttaataatagtttagtgaggtctccaagggcagttaaaaagtgtgatggatttgtatgtgccacatcgggaacatgtattaaagctgaagatagatgtgatggtaaggtagactgtccagatggtantgatgaattttcagattgtaaaacggcagtacaatgccctgggtatttatatgtttgtgattacggtgcttgtataaatcagacaaacaatgcaatggagtccaagactgcagagacaattcggatgaaaatcantgtcctgacgcgccatctgtcaattgcaaaccaaatgaatttgaatgcagtaatggccaatgcatacaccgagatctcaaatgc

SEQ ID NO: 6378 - DNA, 406 bp, Diabrotica virgifera
  Clone ID: LIB150-029-Q1-E1-G6
tgggtcgacacaagactctagacagagtcgttcatatttacgccaagctgggcgtgatgctaggtactgcatgctgaacgcgggagagagctgtggaattcgctcatgcgttgtttctgaggatgtcaactggcttatactcatccctgtaaagaggtcaacatgaaataatgcttttccatcgatcttcttatcatttgaaacccttgaagtgaagttacttcacgttcattttaggttttgcagattttttgttttacaataatcaattaaacttgtcttctcacaaagtctattttatgtggtttttggataatgtaagcgtactgtttaaatatgatattttaagaatttttcatattatgtatttttttaataaataaaaaaattcgagtttgtgtacttt

SEQ ID NO: 6379 - DNA, 430 bp, Diabrotica virgifera
  Clone ID: LIB150-029-Q1-E1-G7
cggacgcgtgggtttcaggtcaaggtggtcaacatccagcgcaacaagagcaccaccaagctcaacaacagcagcgtccatctcaacaacagcaccatcaaggtcctcaagctggacaatgcagaccagcgcgcagaccaagaattgtcatgcgccccgctgctctacgtaaacccatttctcatgataaatacaccgtcgttaatcatggaactcatgctttgaccgcccagatcgttcacgttaaaggaggaaaccaggaagtggtccgcagtcaagttgtccaacccaacgaaacccaagagcttcttcttcaaggcgtaaatggatcatctttgaaaattatcaacgaaaacgagactgattacgctatcttctcagctgaaggaggtgaagtaattgatggattcagatatatggtaagacacta

SEQ ID NO: 6380 - DNA, 485 bp, Diabrotica virgifera
  Clone ID: LIB150-029-Q1-E1-G8
agtgaagatcaaatgaacactaaccaaatcttgagccaaatctacagacaacaacttggacaatctccattgaaccgttatttggtaaacatgagacttgtaaacggagagcaagtatacgaagttcctgaagaattcgttaacgttcaacttctcgaaaaactcttcgccaaacaagaattgatcaaccaagaattgactgaaatcaccgaaagaagacaaccagtcactgaagatgttcactatcagcaacaaatgattaacgaacagatcgaaaaactgattgaacaattagcttaccatcaaaacctcattacacgtgaagttgaacaatacattgttaaaggacaagtagttccccaacagctcgtttaccaacagagattggtttaccaacaagttcatgaagtaattgaacgtttgacctaccaacaaatcttcttgaatcgcctagccgaaagcactgaagcaactgaagtcgatac

SEQ ID NO: 6381 - DNA, 361 bp, Diabrotica virgifera
  Clone ID: LIB150-029-Q1-E1-H11
ggcccgaaaattaatcgagaagtgaaatccattttaagaaaaaaatgggttaataacaataatttatacaaaagtgatatttagatattttcgttgacgcgttgaggatattgtgaaatatatcaaatagtgtcaacatttgaacaaatgactatatatgtgtaaaagactgtagtgatcaccagatccaaaaaagggtgtcttcaagacatgtgttaaacccatgaatctttagaaaagagttaaattgaagatatgagtggacgaccaagaactacatcttttgcagagggcaacatgcatgctaggaatccacctttggggggtatgaatatcagcagtaaagatggtaacaaagtga

SEQ ID NO: 6382 - DNA, 453 bp, Diabrotica virgifera
  unsure (1)..(453): unsure at all n locations
  Clone ID: LIB150-029-Q1-E1-H2
gtcgacccgcgcgtccgcccaagcgtacgcccacgcgtccgcccacgcgtccgatttcgtttaattttatgttaatataaagtactacctattaattaatatttgataaaacatcggaggtcacatgactaatatatttattatagtcttcaacttcagttggcgcgtagggtagtataggattattgtaaagtattacgaatatttttatccacggctgttaaaaactaaggtatttgccacttctatgtaatttagtacaagttttataagtacataattaatattagtgtaaatatttgatggaagtgaccatttcatctaattttttttaggattagattaatattgttataaaggttaataatatcaaacccttagttttcggcctggtttcacaagtgaattgtgttgtggttgagcttcgactctcttnatgacctaaaagactgt

SEQ ID NO: 6383 - DNA, 413 bp, Diabrotica virgifera
  unsure (1)..(413): unsure at all n locations
  Clone ID: LIB150-029-Q1-E1-H3
taggcagagaaattgaattttttagtatataaaatattaccggtgaaggtgatagtgatattactttcttaaattcatggcagatactaaatactacgtaaatttctcacttataatgcttttgatggtctgtaaagctatgtgctctagaaataattctagaatagtaactcttactttgtcccaatccagaaagatgtctttttgtgccaaccttggtttcctttttaaggaagaaaacaatttaataaacagatataaacttgcaaagcaggcaggattttattcagtaaaaaacaccctttccttacggatatganaaagatgaaataatagccgctaaaaatgcagcaaatgttaaccaagttctgataaatatatatactggagatgtttctaaaggggaaatgggt

SEQ ID NO: 6384 - DNA, 430 bp, Diabrotica virgifera
  unsure (1)..(430): unsure at all n locations
  Clone ID: LIB150-029-Q1-E1-H5
taaaacaagtctgtgaaagtgaatgtaagatgttgttttgtagagtttgtaaaatttgtatacaccgttatcagtgtgactgtagagtatatgcagtgagaaataccttgtgtcagcatgtgcacttggtaagaatgtatgaggagagcgtgggtactaactctgttttagatgatgctgcaaggtgtttgggagaaacttcaattatcaaatcaaggcatgaggaggaaattaatgaatttatcagagggacgctagaacagacaaatctaacccaggaaaaaaccaaacgaaatcttcaacaggaatacgtcaataatatgatgaacaaattagatgacgaatcttttgccaaatttatgagggtggttcaaggaccgttggaaaaacttaatgaagaggcantgaacattacanagaagcgaaaaat

SEQ ID NO: 6385 - DNA, 332 bp, Diabrotica virgifera
  Clone ID: LIB150-029-Q1-E1-H6
acgcgtcagcagagagttgtattaatgcgttggagtttgcgtgggtggtggcttagtatgaatagtttatacaagattgatatttatatgtggtgcgttgacacgttgtagatattgtgaaagatatgatatattgtcaacatttgtttatatgattatggatgtgtaagtgactgttgtgatcaacagattggtgtaagggtgtcttcagtatatgtgttaaacgattgaatctttagtgaagtgttattatgatgatatgagtagcctaagaatatgtacatcgtttgtaaagggtaacatgtaagctgaggttacacgtttggggggta

SEQ ID NO: 6386 - DNA, 225 bp, Diabrotica virgifera
  Clone ID: LIB150-029-Q1-E1-H7
caagcgtctatagagagtcgtattaatgatctgcattttaaggttttgttgggttagtatgagttgtttatacagtagtgatttttagatgtctttgcagtgacgcgttgaagatgttgtgatatggatgatgatagtgtcagcatttgatcatataggtatgggtgtgtcaatcgagtgtactaattagcagcatttgatgtagggtgtcaggtcgacatgtgt

SEQ ID NO: 6387 - DNA, 176 bp, Diabrotica virgifera
  Clone ID: LIB150-030-Q1-E1-A1
ggcaaattcagttcagcgcagaagtcgattaacaaatttaagctcaaatggtttcaccttgggaacaaaatttggggtaattgaattacgccagtcaattgatggaaaacaagatttttttaggcaccggtaacgttgaaatcagaaatcacaatacagaatttagaaaccaagcc

SEQ ID NO: 6388 - DNA, 427 bp, Diabrotica virgifera
  Clone ID: LIB150-030-Q1-E1-A12
tatcaatttctaaagtaactgggttgtcaccatgcttcggagggcatgtgaagccgtcagcaacggctacgtaataatcgttacactaaaacctgagccacaagaatggcaactacctcaaaacaagagatatcaaacttctaaagttcaaaattgatcatcctccatgtatttgggcgcccaatttgatataacatgataagatgtaactttatgatgtgtaatgtaagggttaaatatgttacgttatggttatgagagtatagactgtaagcaaattataaaaaattacaaaagttattaaaagaagtaagtcatttggctcagtgctataactcttgataatctttaattatgtttgagtaaagctattaataaaatagttagaaatactctggaaacagacttagttgtataaattccaata

SEQ ID NO: 6389 - DNA, 229 bp, Diabrotica virgifera
  Clone ID: LIB150-030-Q1-E1-A5
acgcctctgtactgacgtcgtagtacttagttatttttatatattagtatttctattttttataaattttttattacactatagatttagattatttacatttagtactgatgataatattagtactaaaacattgtatatttagtagaaacatatacgtttaacaaaggaattcggcatcatttttttcacctgtttagtaatatcatgtcattcagtattaaatata

SEQ ID NO: 6390 - DNA, 405 bp, Diabrotica virgifera
  Clone ID: LIB150-030-Q1-E1-A7
gggtggccccacgcgtccggtactctctctagcaacatggcagacatctcaaaagaagatcttcgcaaagaaattgccgccatcttaaaagatgccgacctttcatccacttctgccaagaaggtgagacaggagctagaggagaaactagaaacaaatctacaatctagaaagaaagaaattgacgatttggtaatggaattcgtcagttcaaagcaggacaagaagaagggcggtaagaagaaggcagaatctgaggaagaggaggaggaggaagaagaagaggacgaagaggaaccttctgaagatgagaaaaagaataaacgcgcctccactggtaagaagccagcagcagagaacgcaaagaatacatcagaagatgaatctgccagcgaacagagcgat

SEQ ID NO: 6391 - DNA, 358 bp, Diabrotica virgifera
  Clone ID: LIB150-030-Q1-E1-A8
cgcgggtggacacaagcctctacacagagtcgtggcatttaccgctcagatcgttcacgttaaaggaggaaagcaggagatagtacgcagtcaagttgtccaacccaacgaaaccaaagagcttcttcttaaagacgtaaatggatcgtctttgaaaatcgtcaacgaaaacgagactgattacgcaatcttctcagctgaaggaggtgaagtagttgatggattcagatatatggtaagaccactgcgtcgctgtcctggtgcaagaaaaatgttctatggattttaagtatttaaataaaatactcatgttctgaataaaaaaaaaaaaatcaaaagataagaaaccaacaacaaa

SEQ ID NO: 6392 - DNA, 130 bp, Diabrotica virgifera
  Clone ID: LIB150-030-Q1-E1-B10
cccaagcgtccggcaagctagtaccatagtaccattagtacggtgagttgtgaaaggttcgttcgactcaggaaaatgaagacggttttttgtgtggtggcgcttgcgctttttggatatgtcagcgctc

SEQ ID NO: 6393 - DNA, 471 bp, Diabrotica virgifera
  unsure (1)..(471): unsure at all n locations
  Clone ID: LIB150-030-Q1-E1-B2
tgcccacgcgtacgcccacgcgtccgcgcatattccatctaaaatgaaactcctgggttattcagcgttctgcgcactcttattgttggcgaacgctgaagacaagtcatcggccacagacacgaaatcagcagagtctcaaaccaaggaaaaacgcggtttgtctctgggatacggtggcggtggacaccaacttcggtggcggccgaaaattccggaggtggcgactacgggggacatgattttggaggtggttacgaccaaggaggacaccatgaacaccatgagaaaacagtcacggtggtcaagaaagtagcagtaccttaccctgttaccaaggaagtaccatatcctgtagaaaaaacagtccatgtcnccgttaaggttcacgttccacagccatacccagttgagaaaaaaggtacctatcctgtgaaagttccagtgaaagtgacagtaccaatacacaag

SEQ ID NO: 6394 - DNA, 469 bp, Diabrotica virgifera
  Clone ID: LIB150-030-Q1-E1-B4
cgaagaccatgtccctgctggacatcgcaaacctcaacaagttaagggtcgtagaactcaataacaaccctggacgtagaccaacatgttaaacaacaatagccgtccctgtaaacaacaaggtagcccaacaggcccaggacgtcgtccattccgtctcccagcttgtaggcaattgatacgaccaggccaatcttcctggtcaaaggtggacatcctgctcaaggtggccatcgtcaagcccaaggtggtcatcatccagctcaacaacagcaacacccagctcaacaacaacaccatccagctcaacaacagcaccatcaaggtcaacaacagcaccatcaaggtcaacaacagcaccatccagctcaacacaatagacctcaagttggacaatgtagaccaatgcgcagactaagagtggttatgcgtcccgctatgctacgtaaaccattgttcatgatagata

SEQ ID NO: 6395 - DNA, 263 bp, Diabrotica virgifera
  Clone ID: LIB150-030-Q1-E1-B5
tcactataaagagtcgtattaaatttacaataagaaagtattttttagtaaaagtagagaaaaattttatgtacgtgatagttaattaggattgtgagagaatattttatttttagaaaagaaaaatttattttttgtgccttgtgtaccagggattaataattaataattcgagaattattagtttcgaacttacaagagctaacaaattaacatttttattgtcatctaaatactttagctaatctgtttgtactgaaatg

SEQ ID NO: 6396 - DNA, 465 bp, Diabrotica virgifera
  unsure (1)..(465): unsure at all n locations
  Clone ID: LIB150-030-Q1-E1-B7
cccacgcgtccggtttcctttggacagtgaaagaaaagcagctatctagcatattagagaatactgtactgttttccgagattgcattaagatttccggaaatttctacttctttattaaaaagaaataaaaactgggatcttgttcttcaatggggtattgcatttacttaccatatgagacaccttttagatgacaataccatacagctgttgaggttagtgagtcaagaattaaatcatgttgagagacacccagattatgtaaatccctatagaaagtctccagaagtacaaaaggatattgtgcaaccaaagcccaagaagaaaaagaaaattatcaagaaaggaccaaagctatctagtcgttttgagttgtaaaaactttttcataatcaataaaaatatttataaaggacttatttttccaaatattananggtaactaatattcaaatacttttgt

SEQ ID NO: 6397 - DNA, 282 bp, Diabrotica virgifera
  Clone ID: LIB150-030-Q1-E1-C4
ttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatgttgtaagaaactggga

SEQ ID NO: 6398 - DNA, 428 bp, Diabrotica virgifera
  Clone ID: LIB150-030-Q1-E1-C5
cccacgcgtccgcccacgcgtccggtttactatcaaggtgtcatgtgttttgataaattttgtttccgcagctagtacattgtttcagtgttgggatttattgattcgtgtggcgcctgcagaataacgaagagaaagcgacgttgccaactgtagttctcattttgtctttatatggatcagtcgaggagctcgtgaaattctagtcagggaaactgtgtccgatcaggaagaaagtcgcagtggttatcaagaaatcacacaagtaatattcaaaatattgtagactttttagaacgagtaaaataacctagaaaaaatggaaaactctacaaatatttttgacgaactgcacaaagtgataaacgtgcatgaagattccagaaccaaagatttctttctaatagccagtccaattccttcaattg

SEQ ID NO: 6399 - DNA, 412 bp, Diabrotica virgifera
  Clone ID: LIB150-030-Q1-E1-C6
gaattgttgtcacaaatggaacgaggaattcaaaaatgatttttaattttaaataccataccatggcatactattttttaaataccattacccgtatgcgcgtcaatgatgaatataaaattcttaattgtatgtcaaaaatgcacaatagctacctcttgaaatccaccaaattgcattacaatgttgccagtaacttcggcaaaatcataaaaaatgtgtaatttttttgtcttcaacgccctgtatcgactggcgttacaaaaatgttttactaagcaaaccaaccccaattttttttccagttttttacctaccctagagacggtgttacctttttttgaaataccctctatgccttgagagataggtacatgtacatcctatcaaaaataacaattttgcaactgtt

SEQ ID NO: 6400 - DNA, 419 bp, Diabrotica virgifera
  Clone ID: LIB150-030-Q1-E1-C7
ccaacgcgtccgcccacgcgtccgcccacgcgtccgattgaaagaaaaatcaaacaacttgtgtctgatgaaaaatcaataatgatggtgaatgatttccatctggcacctgcatcatctgtagttgtcatgaatcaagttggtagatataaccgaagacccgtgtacccagctggacatcgcaaactccaacatgttgtagttcgtagacttaaacaccatcctggacttacatcaggacgttttgcacgtaaaccagcagtatcccgtcctcgtaaacaatcaggtagcccagcaggtttaggacgtcgtccattccgtcgtccatcttgcaggccaatgatacgaccagcccatctttcaggtcaaggtggtcaacatccagcgcaacaagagcaccacctagctcaacaacagca

SEQ ID NO: 6401 - DNA, 304 bp, Diabrotica virgifera
  unsure (1)..(304): unsure at all n locations
  Clone ID: LIB150-030-Q1-E1-C8
actccctataatgagtcgtattaaancttccgccgacgtctccgattgcatgaaaaatgacacatgttgtatccgatgaaatatcaataatgatggtgaatgatttccatctggtacctgcatcatgctgtagtgtcatgtttcacgttgttataagattccaagtcattgtgtaaccaactggccatcgtaggctccaacatgatatccatcgtctacttagtcaggatcctgatcttacatcttgtcgttttgcacgtaattcagcagtatcccgtcatcataaacatctatgtagcccagc

SEQ ID NO: 6402 - DNA, 361 bp, Diabrotica virgifera
  unsure (1)..(361): unsure at all n locations
  Clone ID: LIB150-030-Q1-E1-C9
agncgtccgcccatgcgtccgtttgtcgggtgcgtctgtcgtcttgtgtctgntgggttgtcagtgttgttggtggctgatttccatctggcacctgcatcacctgtacttgtcatgaatcaagttggtagatagggccgaagacccgtgtacccagctggacatcgcatactccaacatgttgtagttcgtatacttaatgaccatcctggacttacatcaggtcgttttgcacgttcaccagcagtatcccgtcctcgtacacagtcaggtagcccagcaggtttaggacgtcgtccattccgtcgtccatcttgcacgctattggtacgaccagcccatctttcaggtcaaggtggtc

SEQ ID NO: 6403 - DNA, 340 bp, Diabrotica virgifera
  Clone ID: LIB150-030-Q1-E1-D1
gttttggaagttatcaacacaagcaagactgaagatgcagtttttagagctgaaggaggagatgttattgaagatcttgagggattagttagaaatattgatgaaaaacaagaaactgctcttcctcttattccaacaaatttggagagcttcaatttagcctcacgttcatccgtcactgcgttgagtgtatgattccaaatgatgtttaccctttccaaatctcttaaattcactgttaccaacaacggaaaatctgacatagaagttgaggtgatatacactgacagcgatgaccgtgccaatgatcaatacaaggtagttaaaccaaatgaaactg

SEQ ID NO: 6404 - DNA, 473 bp, Diabrotica virgifera
  Clone ID: LIB150-030-Q1-E1-D11
gggtcgacacaagcctctatacataagtcgtaatacatctgcaatgtttgcgataattttaaaatgaaaatagatcatgaaaaggatgaagaaaaaaaaaagaagagttcaagcaggaacatacgaagcatttgcaagttgcagaggaggcacagaaaatgggaagagatgatttcaagatagcgactgaacaaacagatcaagagtgtttaagttttgacttggaaaaaaccctaccgcttcccagaagacctacaggcatcgtattttaaaagcgtcagttgtgggtgtataatgcaggaatacacagtagtgctaaagaaaatagacgatacttctacgtttaggtagaaggttcagctggaaggggcgcccaagaaataagctcttaccttataaaacatgttacaactaaattaactccagaagtcaaacatcttacgctttggtgtgattcttgcggtgggcaaaat

SEQ ID NO: 6405 - DNA, 197 bp, Diabrotica virgifera
  Clone ID: LIB150-030-Q1-E1-D2
gtaaatttaatagtgtcatgtaaagtattgaggaaatctaagaaatcgtgaagaatgtcaattgtgccattccatattattaaagtatcgtcaacatacctagcgtaaaatttaatataaactgtaaatggagtaattttcaacaatttattagattccaagtcatttagaaaaatatcagctaatatccgtgaaag

SEQ ID NO: 6406 - DNA, 120 bp, Diabrotica virgifera
  Clone ID: LIB150-030-Q1-E1-D3
agtcgtattataacgtggggtgtcggggaaagctgagaattcgtgtggaaggtcaaatgtgccggtcgatagtaaggatgtagcgacaacatttcaagcgtaagagtttaagggaacctg

SEQ ID NO: 6407 - DNA, 436 bp, Diabrotica virgifera
  Clone ID: LIB150-030-Q1-E1-D5
cccacgcgtccggtttttattttgaacattgtggggaatctcactaaaactgctaaaccttctaccacgccactcgaatcacgaaggataagttgacagatttacatttgcacttgcgtttttatccctcgcgtttaaaacggcgtgcaatcctctaggactggagcgtcctcggtattatcgacacacgcttggaacggcgcaatctttctgctgcttaattacgcgcgattggaatgagccattcaatcacttgaatcacattcaaagaatgtaaatgtaaaggtatggtttgttcaacagtaattggtttgagttcaattagtgctgtcgtaaatattattaaatttatctgacctggcccatggttaagacccacccggagcgattagcgaccgaagtagacagagttggtcttttgcaattaacactgact

SEQ ID NO: 6408 - DNA, 456 bp, Diabrotica virgifera
  Clone ID: LIB150-030-Q1-E1-D6
ctaaacccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatg

SEQ ID NO: 6409 - DNA, 82 bp, Diabrotica virgifera
  Clone ID: LIB150-030-Q1-E1-D9
atagagagtcgtattaaacttcacaccgataatgaaattacgctattaccactgacgtaatttgatcatagaatcacgaata

SEQ ID NO: 6410 - DNA, 469 bp, Diabrotica virgifera
  Clone ID: LIB150-030-Q1-E1-E10
tcggacgccgggtgtccgaggaaattaatcattgatggcaccacggatattatagataataacgctttcggtcaacgtatatccctcggtccaaaggccctcggtatatgcaccattgacctcaagcgttattatccttataatacccttggtaccttaataactataagtacaagaagattccactataatattgttacaaattaagaaagtaacatattagatatattcaatcctttatatctctgaaaatattaaaaaagcatacatctgatttacaaaagaaataagttgtaaaaatgcataagctctcagctgttaatgtttttttgtgtcctttagtaatattccagtgtttttaatatatctcataatattggaatattttttaaagtttaattaagtaaaggaataaagtaaaaagagtcaaaagcatcaattaaaaaaaaaactcgtgtgatgacagctt

SEQ ID NO: 6411 - DNA, 187 bp, Diabrotica virgifera
  Clone ID: LIB150-030-Q1-E1-E12
gcggatcgacgcacgcgtccggagaaccactgggtgtgactaaaattcaattcctctcaaatcacaagtaactgaagcaaacatgtctaaccagcagtattatcctttcaaatggtcaaccactgtctaccccgccgattccttcgaccccgtggcagatgccgccaccttgaagaagggcatgaaa

SEQ ID NO: 6412 - DNA, 461 bp, Diabrotica virgifera
  unsure (1)..(461): unsure at all n locations
  Clone ID: LIB150-030-Q1-E1-E6
gtaatttctcgtcccaaacaaccaaatgcaaatatagcttcgacttcctttgatagtccagccacaacagatgcagcacttgctgccatagctgcagaagctggtctgatagatcctgcacctgagggaggcgtaggaaaattagatggatctgagggaaatgctacacaaacagtagttctttcgcagggaagcagtacatccaatgttgctgctcctgtgcaagtcttaggatctggttctattatgcagcaacttgggttgaaagggggtgctagattccaaagaccacctaaaagctttaggtatcgtttaggattgtatggaggtggtggcgtggatgatgtagatgaagaaatgaaaccttcaactacaacagctgaagctgattctacgcaagctaccgtcaatgaaattggcgccttctcttctaatgctganatttataaaatggactggga

SEQ ID NO: 6413 - DNA, 216 bp, Diabrotica virgifera
  Clone ID: LIB150-030-Q1-E1-E8
caacaccctattatgagtcgtattaaggcgtccgattgcttttataacttcgaaatcctttgtaattcaagtcaccacacattctacacatgcagacataactgctcatgcgagacagaaagatactgcaactgagggaagctttagttactgaaccgtgtctgacgcagatgagacattagcagttattcattcactaggttccagtattatcca

SEQ ID NO: 6414 - DNA, 437 bp, Diabrotica virgifera
  Clone ID: LIB150-030-Q1-E1-F10
cggaaacgtcggatgggactcaactcgctgaggcctaatcgctggtccggggattggtcaatggaacgttgcagtggctttcacacacaacattggaataactgtttattggactcccttaaatggacacattagcaaaaaagtctacatgccaattgaaatgtcgaaacaataaggttccacaaaacaattaatggtccctggtttacaaaaggtacggttgtttaaatagttctgaccaaacaagtaatgaccgagtttacaagacttgctaaaaatgaggcacttttactatatttatcaaccatttttgtgagaaatacttgtattatggtgcctatatggaccaacgatagtacacagcgtatcaatcacgaagttagaccatctcgagctgatgttgtgccacatcaatcatataattatttaaatcaaca

SEQ ID NO: 6415 - DNA, 334 bp, Diabrotica virgifera
  Clone ID: LIB150-030-Q1-E1-F11
cttgaacagacttattggtgtaggttgatgtctctctgcaaagactctctggttatggcaacttccagtgtcaatcatgaggatattcctcactcgaagagatcttaaagaatagaatacgctgtatgagcttcaatcaccagtggttgtacaattccacagtctagtctatgcacgcctatcgtgcatgacttacagcagcagcctgaacgtcagctacagttattgggacatcaccaagcattggcccatcaatatttgagtgcaggacgtcgcccgcactaagatataggttccatcccacaatcgtaaagctgcatctacatataacaac

SEQ ID NO: 6416 - DNA, 259 bp, Diabrotica virgifera
  unsure (1)..(259): unsure at all n locations
  Clone ID: LIB150-030-Q1-E1-F12
ccaaacgtccgtgaaagcacaaacaactattaaaatgacagtgactttgacctngacagctgcgtcaaatttgtttgcatacactgccaaagttcttgtaatccttgtaagttaatgtagatctttttgtaatgtacaagatttgtagatattttgtcctgtaaaatcatttcctgtttaaaagtttttttgtttgtttaaaaaaaaaacaccgtaaagttttaaataaatgtttgtgaaagtgaaaaaagcataacaa

SEQ ID NO: 6417 - DNA, 373 bp, Diabrotica virgifera
  unsure (1)..(373): unsure at all n locations
  Clone ID: LIB150-030-Q1-E1-F5
caaaaaatgaacaataattaccaaaaattaaccaaaactcaacaatgccaaaaaaataatatgaatcgtccgggatttgaacccgcgatctcgcaatctctcgatctctggtccaatgctctaccaaccaggctatcaaggcgcctgttattgacgtttcggatatacataattacacatcacggcgacaagtgaaatataaaaaaagatatattttattattttacgcccaaggaagacaaatccaaagacacaaaaattataataaataatacatttactaaaaaacactaatatattattttaatggcttatattttataatggagaagagatgtctgcttttaanattgtttaaatcactcattgtcat

SEQ ID NO: 6418 - DNA, 465 bp, Diabrotica virgifera
  Clone ID: LIB150-030-Q1-E1-F9
cccacgcgtccgcccacgcgtccgagcaaccaccggcttcaagatggcgtaccgaccacgatccatgcaagagagcacccaagaatattcagtggagacgacgacatattatgaaacatacgaatatgaaaccactttctctgtttcggagacatcgaaactagatcatttcgttttacctcctagaactacgatcttagcattgtctcagagcggaggagataaggaagaagacaaaaagtatgtcgtcaccaatcacggaaaagctgatctttttgttgaggtagtacacctcaataaccaagatgatgctccacaatggtttgtggtccagccagaccaaaccactgagatagccattgaggacagtcttgaacaaagcgtgttgaaagtgagcaacaacagttacgaccaggaggtatcattttctgctgaaggtggtctcgttattgacgacttggaaaa

SEQ ID NO: 6419 - DNA, 129 bp, Diabrotica virgifera
  Clone ID: LIB150-030-Q1-E1-G11
ctagtgagagtcgtgttacttgttttgtcacgggttattttttcgtgtgttgcgcgcatcgacagtccacacgggtgagtcttatcgtgggattattgttactggccacagctggggtctgggcagtgg

SEQ ID NO: 6420 - DNA, 478 bp, Diabrotica virgifera
  unsure (1)..(478): unsure at all n locations
  Clone ID: LIB150-030-Q1-E1-G12
ccggtacgaccacgcgtccgcccaagcgtccgcaagtgggtaaatttaataattgtgttttgggccaagaaccaattccagtccaaatataaagtgctagaaaaaataagcgaaggattaatttcggacgttccaaaatgtgaaaatagagaaacaaaagtatgttacgcaacaaagaaggctaaaaacacataaccatttgaaggaaatttacaaggaatccccgagaaaatttgctgccaaaaaataaccaatcaacccaaaggtggtcaaaatgttggagtaccactatgacatatacacagggaaactgacctttatctttgaacttatggatatgagtatgcatgattacctcaaaacaaagcgtaggggtttgtcagaacatagagttaagttctatttgtttcaaatactgaaaggattggaacacctccacanacacggattatttcatagagacataaaacctgaaaat

SEQ ID NO: 6421 - DNA, 368 bp, Diabrotica virgifera
  unsure (1)..(368): unsure at all n locations
  Clone ID: LIB150-030-Q1-E1-G4
tctacagacactcgtgtgatgcttgctgcaattttcattttgccggcaggacaaaggaaggaattataattatagaaaagttacaggtaaaattgtgaaaattatctgattcaacaaacgatatcgcaaggatgtacgaaggagatgaatacgggagtgactatgaggaaggcgatagtgaaatctttagctcctctttcaaaccgtcctatgtcgtagtggccattgatacgcacccatgcatgttcaaaaaaaagagcgaaaaggaacaaatgccatttcgtatatgccttgaagccttggcagaagttatggaaaccttgattttcanaaaagacacaagaatgtggagtccatttgctgttgtt

SEQ ID NO: 6422 - DNA, 456 bp, Diabrotica virgifera
  Clone ID: LIB150-030-Q1-E1-G7
cccacgcgtccgcccacgtccggcgataaactctcccaactttaggtatacagcagcgaggttgtgttggactattgaaccggtttctccacagttccgggcagagttacatttgaaatgtaaaaagcaaatagacgataatcccgacccaaaaaacgtcttaccgttaatagctgaattgtatatacagctaccgcatctccacgtttatggaacgctattatttaaattatttaaaaagttgcttgatattggaggcaatgaaaatattaagactatatgccaagctttgaagttgactggatattcgttggaacaaagtaataagtcagagttagatatgatattcagtcacctcagatcagttagaaatagagtagatggctctgcagcatttttattggattctctctatccgttaagagcatcgaattggggacattttactgaagaatc

SEQ ID NO: 6423 - DNA, 470 bp, Diabrotica virgifera
  unsure (1)..(470): unsure at all n locations
  Clone ID: LIB150-030-Q1-E1-H10
ccaagcgtccgcacacgcgtccgtggnaagatgcgttgcagtgtattagtcggtttaataattgcatccaattttggatggtatgctgacaacttgaacaacgttgttcaaaggaatgatgaatttacaacgaacacttacaaaggactcgtgaaaacaagtagcaaggaaaacattaatcctaatgggactgtctgcagaaatcgtcttatctttgcttgcaaatggggccaaaagagaaacgcanaaacagctgttgataggtttgggcttacccaataacataacagatgtaaataaggcattcactgaaataacatctcgcctaaaggtcaacacacccgatttaaaattgttatcagcanacaaaatttatccagcgaaaggttttccaattgaaaaagcattccaagatgttgctgtgaatgattataattcaggcgtacaaaatctagactataacaaacctg

SEQ ID NO: 6424 - DNA, 462 bp, Diabrotica virgifera
  Clone ID: LIB150-030-Q1-E1-H11
cccacgcgtctgattggattgttttgagaagtggtaggagtttccattgttgataaattattattcatcatttaattttactggaacgatttaatttaattattatcatattcaagtacggtcctggttttaattgttgttagtaaaaaaccagtccggtgttgtgttgatatgaagattttatttggttagatttccaaaataaagatattatttcaatctaattaatgttcttctactcacgtttttatgtcttcttataacaccaaccgtcgtattctgaatatgtatgtgggtctaccaccgtattctgaagatcagttgggtagaaagagtcacaaacgaaagggttttgcaacgtttgaataaaagttgcgaagtagtgaacacggttaaaaggcgcaaattggaatactttggtcatataatgcgtcacccagaaaaatatgacatacttcacct

SEQ ID NO: 6425 - DNA, 381 bp, Diabrotica virgifera
  unsure (1)..(381): unsure at all n locations
  Clone ID: LIB150-030-Q1-E1-H2
cctaaattccggaattaatcctgggaaggttgggttaaaccggaacggatgacaaaccttggaaaaaagtaccgtaacccgaaaagaaaaatttataccccgaattatactcacgaataaccaactacacaaatgctgactgtaaggtatatattgataatgaggagtttaattgtcatttaatagtactccagtgttactcagagttatttgatgcctatattgcagttaagaaagtanagctgccatcggacaaatgtaccgcaacttcctttgcatttatctacgaatggatgattactggtgaaccttcttaacgggagcttacaagggataacgtactagacatttttaacagcgctaaatatctcaaaatcaaag

SEQ ID NO: 6426 - DNA, 451 bp, Diabrotica virgifera
  unsure (1)..(451): unsure at all n locations
  Clone ID: LIB150-030-Q1-E1-H7
tgtaactaaccttggaaaagctgctttcgatattgagttgaagcgtacctcacccgttcaaactctagagctccatcgcaaaaccgttcagcctaatacatctgagtcttttgaactcacagctcaattccaatctaccgttttggaagttatcaacacaagccagactgaagatgcagtttttagagctgaaggaggagatgttattgaagatcttgaggatttgattagaaatattgatgagaaagaagaaactggtgttactcatattctaacaaatttagagagcttgcatttgaactcacgttcatccgtcnctgctttgatgtatgatcctaaggatgatnacatttccgaacatcataacttcactgttaccaaccacggaaaatctgatatagaagttgaggttacatacactgacagcgatgaacgtgccaatgatcaatat

SEQ ID NO: 6427 - DNA, 264 bp, Diabrotica virgifera
  Clone ID: LIB150-030-Q1-E1-H8
cgcgaactttgatcgttacaagtggaatcgatcccaatcaagatataaacaaaatgagttccaaagacaatagcgatgttgcagtcgacaaattagacaacgaaaaaagtacagatggcaaagcagagataaaaggaacgaagcgagcggcagaggacaaaacagaagaccccaaaaaagcgaaaaaagaagaaaatggtgcaaattcagacggtgaggatttagacgaggaagaagaagaggccattgaagaagaagaagaca

SEQ ID NO: 6428 - DNA, 426 bp, Diabrotica virgifera
  Clone ID: LIB150-031-Q1-E1-A11
cggacgcgtggggaaaattcgtatttctcatcctttaataacgaaaacatgaacaaattcttagtcactaaagatacatttaagaaaattcgtaaatttggcctccagggacgaactctggaatttaaaatcagggatgtgccgcagagtgaggaacctgtgggatgggtaaaaaaggccatcgaggggattgtacttaagggaacagaaggtttggaaccaaccgatcaggtcggtttcactttttgctcgaaagactttgccagaggtcagggttggatgaggttcaaacctgcctctgaagtgaccgttgatgatatatggaataagattagttccagatatcagagtaatagcaccggcctcaataccgagacattttgtttgggtattacgacggtaaaactgcccgcgggaaaaagtggt

SEQ ID NO: 6429 - DNA, 293 bp, Diabrotica virgifera
  Clone ID: LIB150-031-Q1-E1-A12
aattcgtatttctcatcctttatgaacgataagatgaacaaattcttagtcactaaggagacatttaagaaaattcgtaaatttggtctccagggacgagcgctggaatttaaaatcagggatgtgccgcagagtgaggaacctgtgggatgggtaacaaaggccatcgaggggattgtacataagggaacagaaggtttggaaccagccgatgaggtcggtttcaccttttgctcgaaagactttgccagaggtcatggttgggtgaagttcacacctgccactgaagtgac

SEQ ID NO: 6430 - DNA, 115 bp, Diabrotica virgifera
  Clone ID: LIB150-031-Q1-E1-A2
aagactctatagagagtcgtattaacttttacgtcaagtgattttgagttcgtgtgatgactgtcttcaagacgcgtgtcgaaagcctcaagatggacgttatataagagaggtg

SEQ ID NO: 6431 - DNA, 489 bp, Diabrotica virgifera
  Clone ID: LIB150-031-Q1-E1-A4
cggaaacgtggcggacgcgtgggtagcgcgtgagtttgtaaaagtaaaagcagacaaaaggcatttcatggcgaatgtttgtaccactaataatttttgtcaattcatctgtaagaaaaaaaaaataccagcaaaaagaatttgctacagtttgacgccgcaattttcaactggggtttcgaaaacatttttgatactttttatattcccattgatgtttttatacagagatttgtaaattgtagataagcaaattgcaactcgtttgaaaatggcgacaaactgctttttgtatttttttgtaacgtgcatgaaatgtcttgagaccttatgtcatgctgcaaaatttttccttcataacaataaaataaaaaaaacattgtaaaaattcgacgccttgtcttgtcaacattgacgagcgtcgtaccaaaaaaatatgattgcaacatctaacttttaaaagtcttttccatcttgtgagcaaaagga

SEQ ID NO: 6432 - DNA, 319 bp, Diabrotica virgifera
  Clone ID: LIB150-031-Q1-E1-A5
tggagaaacgcgcggtattttagtattgacaattgcttacgctcaagatgaagatgatgacgattcaggggaaccacagatcgaccagctgtgtgaaaacaggcctgctgatgaatattttaggttaagcactgatggagactgcacagaagttgtaaggtgtacaaaatccggtctaagacagatcacttgtcccagtggattggcgtttgacatcgataaacagacttgtgactggcacggaaaagtcacaaattgccataaacttgagacaccattaaaagtccttccaattttgaaaaccgaccaaccaagatgt

SEQ ID NO: 6433 - DNA, 429 bp, Diabrotica virgifera
  Clone ID: LIB150-031-Q1-E1-A9
ccgggccgacacacgcgtccagcaatttccgagaaaagaccacgtccacatttaagatgaaggcttactttgttttcctgattgtggcagttacatttcttcatgtagaaggttgggtagcaataacgccgtctgataaaggaacagaacatctaagtgattgctactcatctgataaaggtataggttccatgaaatttggtgaaaagaagcaacaagaaggacactgtgttcaattaacctgttcaagcggtactagatatattcacgaagcatgctgcggatctgtaagagcagaacctccatgcatagtaacatctgaagatctgtccaagccttatccagactgttgccctgacatatcttgtcctgatgcctaacaagccttcgtacaagaaacatgaacggatgtaaatacattatcaattt

SEQ ID NO: 6434 - DNA, 464 bp, Diabrotica virgifera
  Clone ID: LIB150-031-Q1-E1-B1
ccacagcgtccgctgacgcgtgggccaagatgaaggtactcactcttccatcggtcgttgccttgagcagctgcttagcagcatccagaaatcgacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcatccaagctgaaaatgtcgagttaccttggatgtatcactcttgggatgtccaggatatgcaaaacttaactcccgttcaacgtgttcagttgctactcaactacgtcagacttcaccaacaatggacacaatggacacatgatgtaactgccaatgaacgtcttcagaatatgttgtatcaacaccttcctgaacacttatgg

SEQ ID NO: 6435 - DNA, 460 bp, Diabrotica virgifera
  Clone ID: LIB150-031-Q1-E1-B12
ttaagctttacacaacttacccaagcaagttacaatgaattactttttgtatgtatcattcttagtggctctcgcaaccgtaaatgccggttacgcaggcagttacggaggtcatgaaggctatggtggagaccacggcggccatgatatttcccacacggtggaaattaccaaacacgtgccaattcctgtctacaaacacgaagcagtaccaattccccacaccattccagttccagtgccaaaaccagtagcagtaccagtaccacaaccttaccccgtccacatcaaagttccccaacctattgccgtacctgtcatcaaaaccatcaccattcgcgtagagataccagtaccttacaaggttgaaaatgaaatccataacacgttgagaaaccagtaccagttccagtagaaaaacacgtacccatcaaaatccccaagccagtacccgtcaaag

SEQ ID NO: 6436 - DNA, 426 bp, Diabrotica virgifera
  Clone ID: LIB150-031-Q1-E1-B2
caagactctatacaaactcgtataagaacactctttttgtagccatcttcgccactttggctgttgccgccagtgctggaggtattggacctcttggacttggagttggaggactaggtcttggagttggaggactacgtcttggactaggaggtcacggaatcggcttagctggtcccgtcggtttagctggccacgtcggtctagccggtcccgttggtcttggtcttggagtaccagccctaggagtcggtgctcctctcggtttgggactgggacttggacatggagtcaaagtagctgccgtagccgtacacgccgtcagagtacttgaagcttccggagtagtcactggagctggagctgctggatcatctggaatcggtactggagctggtgcggtcggacgttcaggaatcctaactg

SEQ ID NO: 6437 - DNA, 331 bp, Diabrotica virgifera
  Clone ID: LIB150-031-Q1-E1-B3
cggaagctttggctgaagctttggagagtgcagctgaagttgatgtaacaccttgttagttctagtgccttgtgtatcaaggattagtaattactgcctggacatataatacgttcaaacatagaacatcttgcaacatacaaggattatagtggaataactcattcagatatcttctttggggagcatggattatcatgggtaaatatatcgaaggattcgctagcataagttatttttatttaacattacttgatttacatttccttggattcacatcattaatatgaaataatttgacagaagataccaataggcaatgttcattaca

SEQ ID NO: 6438 - DNA, 421 bp, Diabrotica virgifera
  Clone ID: LIB150-031-Q1-E1-B5
taaagcgtcatataacttttactagcagtttacaatgattttctttatggatatttcattcgtagtgtcacacactatcttattttcaggttacacaagcttattttgtggaccttgtggctcagggattaatcactgaggcctagatatttcccactttctggtttataacagcacgtgccttattcattgtcaatgtcacatagctattttaaatccctacattgttctgatacgttagccgttttcagttacagtcacaattttttaagacataccttgtctttatctattttcaccatacttatgccgtaccagtcttctattcatcatcattcctatttttagggatgtgcttaacaatgttgttttagtaatctcaaacttctatgtaaaacctatgccaattccatgttcatat

SEQ ID NO: 6439 - DNA, 197 bp, Diabrotica virgifera
  Clone ID: LIB150-031-Q1-E1-B8
aacaccctatagagagtcgtattagtgcgatctcaataggttatggtgactgatatcaccacaggtatattcagtgggaaactatgtagtatttctcatacacatagtgtaaccgccttgcgcgatttcgagatgtatcgaaactggctaagattcagttttatcgtcctatagagactaacttaggagtatcacag

SEQ ID NO: 6440 - DNA, 460 bp, Diabrotica virgifera
  unsure (1)..(460): unsure at all n locations
  Clone ID: LIB150-031-Q1-E1-B9
tacacacgcgtctggtactgcgaaccgaagatggcgtctcaagttgaaatggtgccagaagcccataactagtgtttttttgaagtatttagtcttcaatgatgcgaaatcattcctttagatggtgtagtatctgaatcaaatgccttttgcaagtattgcaacccagaactcatggaggatttgtttgggcgtggcatactattgcgtattagaattttgaagccctgtgtagtcaaatatggtccagtttttaataatatggttgctggagaatcttgccaatcgtttccttttgctgtacacaggtttttgtagaagatggattgttgttcctgtttccaagttatgcttcctacgcctcttgtcaatgacaccgatgtctgtttgttttgtttgagtgtgacaatganatgttaataacaagaatgtactgtaaatcttgtttataatataaaaa

SEQ ID NO: 6441 - DNA, 450 bp, Diabrotica virgifera
  Clone ID: LIB150-031-Q1-E1-C11
tgcagtgagactgaccagtaccaaaactgcattacgatgaagtggatagtgttaaccgttgttgtacttcttggtttagccagtgcagaagaagtttatgaaaagagagcagtcctcagaagaaccaccagacaagccctaggatccatgggaggttcatttttagcacaaactgaaaggaatattataaacaactgtaagaaaaatggactatcagatcaaggcgctgacgatctacaggttacatacgctaaaatgaagtcgtgcatgtccggcacaaaaatttttgaaactcctagaaatgaatttattagcaaaatggaagattgcagtcgtgacgcaattaaagaaactaaatcttgtttggctaacaaccaaaaatatttcccagaattcgtcttggattctgcaaaatcgatggttaaatatatgtacgatgacaaagatcta

SEQ ID NO: 6442 - DNA, 287 bp, Diabrotica virgifera
  Clone ID: LIB150-031-Q1-E1-C12
atagtgagtcgtattaataccacaactgcattacgatgaagtggatagtgttaaccgttgctgtacttcttggtttagccagtgcagaagaagtttatgaaaagagagcagtcctcagaacaaccaccagacaggccctaagatcgaggggaggttcatttttagcacaggctgaaaggaatattatagacaactgtaagacaaatgggctatcacatcaaggcgctgacgatctacaggttacatacgctaaaatgaagtcgtgcatgtccggcacagaaattttt

SEQ ID NO: 6443 - DNA, 420 bp, Diabrotica virgifera
  Clone ID: LIB150-031-Q1-E1-C5
acaccctatagagagtcgtattaatgagcaatctacttatagttaaatatttttatgttaataatattacgtcttcttagggatgcgcttacacatgacatttcagtaacgtttatgttccacaggtcagttaggataaatgagttgcacatcttagcgtgtgttattagttatttttagataatgactatttttagcttttatacatcttttacgacaacacatattccacctgcttatattcagtaatgatgatcatattcgtatcgtggaattctgtatctagtagacatatatgcgttgactactggaattcggcaacatttttttcacctgtttattaggaacatgtcattctgtattaagtatggcgtctcgcctgcccactgactgagttgaatggccgcggtaagttgaccg

SEQ ID NO: 6444 - DNA, 451 bp, Diabrotica virgifera
  Clone ID: LIB150-031-Q1-E1-C6
acactctatagtagagtcgtattaatgtgcattagaattaaagtgcatcatgtctacgtgctaccagctgtttgtgatgtggactcctactgtgttagatgtgtgagtacggctaatgggcccttggttctcaaggatgtatgtgcgggtgatatgaacgtaggtgatactttcgactgtgaacattcagatatctggatacactaagatgactttggctggatgtggagtacatctatcttgaatggctgaccctcagcatctacatctgcctgccttctgatggaatttaatccatttagtcaggatttgtagatgacgacctaagagaacagtttttattatcagcaaccgtacagatgggacacacgtgtaccactcgatagaattctggttgtgctatagctggcgcgccagataactacttactcgggtcaaagttgctcctcat

SEQ ID NO: 6445 - DNA, 449 bp, Diabrotica virgifera
  Clone ID: LIB150-031-Q1-E1-C8
caagactctatacagagtcgtattaaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaaaacat

SEQ ID NO: 6446 - DNA, 416 bp, Diabrotica virgifera
  unsure (1)..(416): unsure at all n locations
  Clone ID: LIB150-031-Q1-E1-C9
cttatgcatgtggtcaaaagaatattctttcaccgaatatactgagtacgttcgtgtacgtagtatctcggaatgttcgtaaaagtttattcttagaatataccttaatcgaatattcttagtatatgcgtaagtatatgcaaaagtatatgcttaacacatacttgtatatacttttaaaatatcttaaaaagaatatactgtatattcctagaggaagaagaataatgtttaacctatagattatcaacttcgcgttaagaataattaataaagtttaggtattttggtaggtactactgaactatctaattcatttntttataccgtgttaattgtatggaaataaggttaanacttaattctattgaagaaaaatgagaaattctcgtttcgttttcaattgaagtgaatat

SEQ ID NO: 6447 - DNA, 457 bp, Diabrotica virgifera
  Clone ID: LIB150-031-Q1-E1-D10
cccacgcgtccgcggacgcgtgggcgttgatcgaactgttttttctttgattgttgaatgataacaagtgtttttgaagttttgcaagtgcccgtgtaggggtgtgaatgaccgatttggatttttgattttttataatgaagatcattcttcttatcctgctagcgatatgtacgatacttagcgcagcggagtaccccagatacaaaggcaggcctccacctccacgacaacgtagggtaccaaccaatcaacagttctccaagaaatggcaccaaggaggtcctttaatacaaaatttgccacaaggtattccacaaggattcacgcaaggcatgcaaggagttcctccaggacacggccagttcggcttacgtgggccacctttaagacagagacccggtcaacacataccggtcttaatggtgccgaacaatgttcctcaaataaaacatca

SEQ ID NO: 6448 - DNA, 281 bp, Diabrotica virgifera
  Clone ID: LIB150-031-Q1-E1-D11
cctatagagagtcgtattaacgcgtgggcgttgatcgaactgttttttctttgattgttgaatgataacaagtgtttttgaagttttgcaagtgcccgtgtatgggtgtgaatgaccgagttggatttttgattttttataatgaagatcatgtcttcttatcctgctagcgatatgtgcgatacttaccgcagcggagtaccccagatacaatggcaggcctgcagctccacgacaacgtatggtaccaaccaatcaacagttctccaataaatggcacc

SEQ ID NO: 6449 - DNA, 474 bp, Diabrotica virgifera
  Clone ID: LIB150-031-Q1-E1-D2
tagaaaaagtcacatgattggttaatcagatatttttctctatcaaactccttgttttaatcatccttctttcttcttaattgcctttctttcttcctattgtgtttctgaagccaaactgagtggtaccaatatcttgatcaagtttctaaaaattttttggtgtattcttttcaagaatatctttagagtgtggcttattaagctagtatgatggtcactgaaacacttaagggagtattagatccgacgatggatggaatagctgctgcttataataaatacaaacaagaaccagaaagtacaaaatgataggaaactgtgtcaatgtttcttggaacctagaaagagttttatctaccgatacttacagatacagattgttgaacagataatagtaatatgcgctacaataccatgacggtcgacattgctagaataatgtctggtgcaacaattcaatatccaggccat

SEQ ID NO: 6450 - DNA, 472 bp, Diabrotica virgifera
  Clone ID: LIB150-031-Q1-E1-D4
cgggtcgacacaagcctctagacaaactcgtattagcaacaacatgaacactctttttgtagccatcttcgccactttggctgttgccgccagtgctggaggtattggacctcttggacttggagttggaggactaggtcttggagttggaggactaggtcttggactaggaggtcacggaatcggcttagctggtcccgtcggtttagctggccccgtcggtctagccggtcccgttggtcttggtcttggagtaccagccctaggagtcggtgctcctctcggtttgggactgggacttggacatggagtcaaagtagccgccgtacccgtacccgccgtcagagtagttgaagcttccggagtagtcactggagctggagctgctggaccatctggagtcgttactggagctggtgctgttggaccttcaggaatcgtaactggacatggagctgtatgacccacggtc

SEQ ID NO: 6451 - DNA, 310 bp, Diabrotica virgifera
  Clone ID: LIB150-031-Q1-E1-D6
tctatagtaagtcatattactgtgttttcgagtaagtgttacttaatattttttagagatcatcatgtggcattccgctcaaatgcattctggacatcgcggtaagctttatgtagcgaacctcggggaacacggctccgttgttcactgttacagccttaccgagatccgaccattagagacatctgaacctccatacttgatttgaatcaatgtctacaacatcgacgcctctggcttgaaatgagtagtccgtgccatccacgtcgacctggtttctggtaacatggattcaatatagtcaggacca

SEQ ID NO: 6452 - DNA, 450 bp, Diabrotica virgifera
  Clone ID: LIB150-031-Q1-E1-D8
atagagagtcgtattataaactgctcttcctcttattccaacaaatttggagagcttcaatttagcctcacgttcatccgtcactgctttgatgtatgatcctaatgatgttaccctttccaaatctcttaaattcactgttaccaacaacggaaaatctgacatagaagttgaggtgatatacactgacagcgatgaccgtgccaatgatcaatacaaggtagttaaaccaaatgaaactgtacaaattgagcataagaaagacgctggggtaactctgttaaatgtattgaacagagattacacagaagtcgctattatcaccgccaacggtggaagagtagttagagacattgaaagacaaatcaaacaacttatatctgatgaaaaatcaataatgttggtaaacaattacaatctagcacctgtatcatccgtagttgtcatgca

SEQ ID NO: 6453 - DNA, 476 bp, Diabrotica virgifera
  Clone ID: LIB150-031-Q1-E1-D9
ctcgtgggtcgacacaagcctctacagagacgtcgtactagaaactgctcttcctcttattccaacaaatttggagagcttcaatttagcctcacgttcatccgtcactgctttgatgtatgatcctaatgatgttaccctttccaaatctcttaaattcactgttaccaacaacggaaaatctgacatagaagttgaggtgatatacactgacagcgatgaccgtgccaatgatcaatacaaggtagttaagccaaatgaaactgtagaaattgagcataagaaagacgctggggtaactctgttaaatgtattgaacagagattacacagaagtcgctattatcaccgccaagggtggaagagtagttagagacattgaaagaaaaatcaaacaacttatatctgatgaaaaatcagtaatgttggtaaacaattaccatctagcacctgcatcatccgtagttgtcaagcatc

SEQ ID NO: 6454 - DNA, 450 bp, Diabrotica virgifera
  Clone ID: LIB150-031-Q1-E1-E12
tcgtgggtcgatacaagcctctacacagacgtcctgggaaaacgttagcaaagagatgattactagtcactttcaactactttctataccttcatttcattaatatgaactaaaaatgccgaatacaaatatatttaatcagtcaatgtatactgttttgtggctttgacttttaaatgttgttacaactatcatccctcttggctgttaggggtatcggcacgtcccaattaatgccaaaaaaatcaacagacctcaagggggattatacagttgagtccagagttctttacccgtgcgtcatcttaaagtatacgaaataagtcagaaatttactccacgcacagcaagtcacagaaagtggctactgctccgatcacgagttatattataaaatttgacgttatcaaataaatagaatgttaaatgtaagttttgctttaaaatttt

SEQ ID NO: 6455 - DNA, 165 bp, Diabrotica virgifera
  Clone ID: LIB150-031-Q1-E1-E4
tcgcgggtcgacacacgcctctatagaaagtcgtactaacttggctcttactagctacaactggcaactgctccagtttctaatcttccactcgtcgtgctatcaatgcatgagtctcgattcgcagcacatatcctgcgttagggccgacctggcagtatctaa

SEQ ID NO: 6456 - DNA, 67 bp, Diabrotica virgifera
  Clone ID: LIB150-031-Q1-E1-E5
aacaccctatagagagtcgtattaacacatcggagcacatattatgactactcatgtccggaggact

SEQ ID NO: 6457 - DNA, 259 bp, Diabrotica virgifera
  Clone ID: LIB150-031-Q1-E1-E6
cgtgggtggacccaagactctagagagagtcgtactagtatatcgtaactcaaacgaacagtcaagatatcgggaagaatcgaggcttgaagctctaacgaggaggaagttaccaacatgttggcggcatctagtcacctgggaacagcaaatgttgctcttcatgtggaacagtacgtatagaaatcgtcctcatgacggtactcacagcagcagcttaaggaaaacgtgggaacggattcgcgtggcagccggtgcc

SEQ ID NO: 6458 - DNA, 147 bp, Diabrotica virgifera
  Clone ID: LIB150-031-Q1-E1-E8
aacaccctatagagagtcgtattagacgttgtgactggcagccaggagggtctcgacagcttgccatgcatcctttatcgatatccgcatcatcgctcttgctctatctcgaaacgtcatacgtggggagatttgagtatcatagtt

SEQ ID NO: 6459 - DNA, 390 bp, Diabrotica virgifera
  Clone ID: LIB150-031-Q1-E1-F10
tcgcgggtcgacacaagcctctagacagagtcgtattaatgtggcttaaatttttgctgttgtttgtgatgtggtggagtgtcaatacggccgaacaagtgaatggaaccggggaattgccattaaaggattgcctcgattctgaaaatatagttccttgtttagcagaaaaggcagcttcaacattcgaaaagtcattaaacagtaatatccaccttttggatggactggaactgcttagaaacgaccaaaagatcaacccaaggagagctaaatccctcgatggtgtacaaagactttttacagcagtctcagatttcatcgacactcattctttttccattgatttaacacgtggtcgagctttggacgacgatgatgaagaatacg

SEQ ID NO: 6460 - DNA, 481 bp, Diabrotica virgifera
  Clone ID: LIB150-031-Q1-E1-F2
ctctagtgtgcctcatacgacaggatgttccacgtcgccaacgttgttataacttcattcatataatacaccatccatcgacacatccttcatcattttatccacaggctacctcgtgacctttgccgtcggagctagggctcttcagtgaccgtgagaactgcacgtgacccgcggtacctgactatttctaacttattacgtatccccttcgatttgtaaaaatgtccattttgtgtaaagatagatataaatttagtttaagttggtctcagacataacatatacgatttttggttttcttattttctttattgatttaactaattgtacaaaaagatgaacatgtcaggatggcatatcctgccaccgtcacacccggaagtcttgaaacataaaaatggagtacataatggtctttagattggtgatcaatcattatcgtgtaatgatttcaccagatatttttgacgagggagac

SEQ ID NO: 6461 - DNA, 409 bp, Diabrotica virgifera
  Clone ID: LIB150-031-Q1-E1-F5
gtcgtactaacatgcctgagcgccaggtgtgacatgtcgtgacatgttcctttcagtctagacgtggtacagacgattttcgtatcttggggttcgaggtctgcaatctgcgtctcaacgatttacaactatcgtccattgtcatagctctgatatattcacgacactcgagtactagtggaaatagatcattgcagagcgatcggtacgaactcacgtgcaagcaatgagtccaatcttcatcagcagattccgggtattggttgcacacgaagatcacggtgaaagcaatctagctaaagcgcagtagccaattcgtaagactcttgatatcgatccagtaggtaattagatcctgatttctacggagtgcagatcaatcacacctttcgcatacgacactgcgtta

SEQ ID NO: 6462 - DNA, 370 bp, Diabrotica virgifera
  Clone ID: LIB150-031-Q1-E1-F6
atgtactctttggtagagtcgtggcagtcacaatctcattcgttgcactcgaaatcataacttcgcaaagtgacgattgtagaggcacgcacctccaagatgggtgacgtcaagttgctggtcgataacttgtcggtggacagctagatcctggggaaacctatagcattggagattgaattgagcatctgtctgtagctaaagacgtaccagcaagcagttcgatggggaagaccacgatatggctaaccgttcactcaaatacgccagcgaaggcgagcaagttagggcatggagagcgtgtggaattaccattgatattgcctagtgtaaattggagacagcttgacagtatctaacgatcattggt

SEQ ID NO: 6463 - DNA, 508 bp, Diabrotica virgifera
  Clone ID: LIB150-031-Q1-E1-F8
tcgcgggtcgacacaagactctatataaagtcgtatgagttgtttttaagggttgaaagggggttaacaatatgataattaaaatagagaacgtaaaatatcatttactctatatttaaatctttttatatcatactaaataaattttttgtaaattttttcgatttaggggttgtttgcaagggttgtacggttttcaaggggatgaaaatgagtttagaggttaatgtgttagaaatcacttcacaatgtcacctttgttccttgaagtatcttctaactactcaccaatttccatgaaaatcgatgaaggttcaacgaaatcggaggtgaaaaccttcagtgactccactatatagaaaccaagccattccaatgttttattatcaatgataaactttattgtgttagtgatatagttcttcaattccaaggcaaggttgtgaaaatgagcgttttcaatgaatttttgtttgtccgaacatttagttgttagagctcgtatatg

SEQ ID NO: 6464 - DNA, 395 bp, Diabrotica virgifera
  Clone ID: LIB150-031-Q1-E1-F9
ctctaaaaagattcgatcgagaatatcgtatgcaaggaattagtgacattgtccccgtccaaggagtacgtagcctccgccaatatgctggacatgtaggaaatgttatgcctcttggacaaaatttggaatatggaaaccatagaacctgggctcttgaccaaggtttgttgcaaacttattctccactcagacatttccaaactcttctcggacaaatccaacaacaacgtcaacttcaacaaggtttattgagccaacaacaatatttgccccaacaatatctatctggagaatcccttcttgaagatcatatgaacactaatcaaatcttgagccagatcgacagacaataacgtggacaatctccattgaaccgttatttggtaaacatg

SEQ ID NO: 6465 - DNA, 506 bp, Diabrotica virgifera
  Clone ID: LIB150-031-Q1-E1-G1
gtgggtcgacacaagactctacagagactcgtattactctattgtactaattgtaaccattttcttgttgtccttttgacatttaccaaacatcacttagctgtttctttatatagttcatttgttctaatgtattggcccacaatattttttacttctagtaccatttctcattatcgaatctgctaacttcctagtcctagggatataaatatgtaacaataagcttctttttgattccggtacttacttttcgtgcccggaataccaacaactttaaattctgtacttccaatggatggccacgtagatggccctatcatttgctaaaattaaatcttcttactgtgcaggtgtctctctcatcgctgtgcgtgatagtagagactattctgaacagcgccacagtcactggtatcatctttctggtatccccattctttcaggtttctagtatccccattctttcaggttactagcacaatgtgaaacgccgattcttaata

SEQ ID NO: 6466 - DNA, 457 bp, Diabrotica virgifera
  Clone ID: LIB150-031-Q1-E1-G10
tacataaagccccaatacgaaagcactgaagcaactgaagtcgatactatttccattcaaagatgggttgtacaacaaaatattattaacgagcagatccagcaattgatccaacaagttttgtaccaacaaactcacgtaaggcaacaaatccaagtattaattcaacaaggacatgttatcccacaggaacttgtcctctaccaaagaattacctaccaacatgttgaaaggtttcttcaagttttgattaaacaattcgtatatcaacaaacctactacaaacagttgatccaggtcttggcacaacaaaaacacaccattccccaagaattggtttcccaatactttgctatttacacccaaatacttcaattgatccaacacggagatgctgtaccccaagaattggtctaccaacaaagacaaatccaacaacagatcgtactcatgctcc

SEQ ID NO: 6467 - DNA, 437 bp, Diabrotica virgifera
  Clone ID: LIB150-031-Q1-E1-G11
tggccttcatcatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttgggaaacaac

SEQ ID NO: 6468 - DNA, 460 bp, Diabrotica virgifera
  Clone ID: LIB150-031-Q1-E1-G2
tgaaaatactgctcacgagtgcgcatgatttctcgacaaacaatgaagtggtacataataaagttaccattttccattccagaggccacaaaactacactatatagaaaatctatgattcttacatatactagcgacgatttacaaaatcctctgtttgcaatcagaaatgccggtaaaaaataagggaaacgataagaactttcgacattatagtgcagtgcgcaccatttatcaatcagtgcgcatgattaccctcatggctggggaatcgtgcacaaaggcacttcttttcattttttactattctactttagtatgtactttgtatttctctaaaacctattttaaatattcagagtagaataattagagcttactgtaacatactatccgttatgatagatttaaagaatttacaacaggatcgatttctgcttaagtgcgcactattctcccac

SEQ ID NO: 6469 - DNA, 484 bp, Diabrotica virgifera
  unsure (1)..(484): unsure at all n locations
  Clone ID: LIB150-031-Q1-E1-G3
cacattcatcggtcactgctttgatgtatgatcctaaggatgataccatttccgaacatcataacttcactgttaccaaccacggaaaatctgatatagaagttgaggttacatacactgacagcgatgaccgtgccaatgatcaatataaggtagtcaaaccaaatgaaactgtaaaacttgaacataagaaagacgctggagtagctctgttaaatatattgaacagacattacacagactctgctattatcaccgccaagggtggaagagtagttcgagacattgaaagaaaaatcaaacaacttgtgtctgatgaaaaatcaataatgatggtgaatgatttccatctggcacctgcatcatctgtagttgtcatgaatcaagttggtagatataaccgaagacccgtgttaccagctggacatcgcanactccaacatgttgtagttcgtnagactaaacaccatcctggacttacatc

SEQ ID NO: 6470 - DNA, 454 bp, Diabrotica virgifera
  Clone ID: LIB150-031-Q1-E1-G4
tgcccaagcgtccgatatgttcaactggaatttcaaaataaagtatttattttaattttttttaacacaatacctcaaagttttgaaggaatggttaatatagtgatattattaattagttgtcgaattaaatataaagctgtcgtatgatttggagtaatattgagatttattcattcaaagctgtcgtattccccgcacaatggctcacaatttatccaatttgaggcagttcctgccatgtagagatatccaaatcgaactgctctataatctgtttgcatataaagatgaacctcaaattgaaagcgtctacgtttatggagggccaagcagtggaaaatcaattgtggtcacctcgacactcgagcacttgggtatcaatcacgccatagtgaatattatcgaatgttactcatcaaaattccgttcgagaccattttaaattaaataa

SEQ ID NO: 6471 - DNA, 408 bp, Diabrotica virgifera
  Clone ID: LIB150-031-Q1-E1-G6
agaacatgcagtacatagtgttagttagtgtaatttttttattatccgacgtcaggaccgaaacgacgcccgtgtatggtggattgcagattttgacgaaggtgtttcggcagtatttgaagagtcagccagatgatgtcaaattgggagatggcgttcatattgtcagcgtcaagagtgaaaacgatgcgagggctattgtggatgatggaaccgtcttaggggtcattgaacattaccttgaaaatcatgagttgagaattcgactgccggaactgatgccgggtgaaggatttggtagagcgtttaagacggcgatggaagaagtggatgccaaagatgaaagtactggaagaggcaaaggacgaaaacgcggtggaggaatgggacgagtcatgatcatcggtc

SEQ ID NO: 6472 - DNA, 446 bp, Diabrotica virgifera
  unsure (1)..(446): unsure at all n locations
  Clone ID: LIB150-031-Q1-E1-G9
attttgggggcaacccctgcataggaatcttgtagattataagctcattataggttgccagtaaatattcattaaactttgatgtagattccacaaatgtatgtcattagattgacatgcaaaatcagtagtaactcattcttgtctgaaactattgtttattctaataattccatatagcctgtgatttaatttatactttgtgattgtatacatatatcattccacttctagataaatgcacacattctcaaatatagtttaaaaaattgaactaaaagaaacgtacatgccagaatataataatatattaataatattgttttgtttaatatctatagaatatttatttttaacttatttgaatacaataacttattcgctcatcncgaagaaaagtgtcacaactcanaaaacaactttttttcaggggagacanatatgga

SEQ ID NO: 6473 - DNA, 263 bp, Diabrotica virgifera
  Clone ID: LIB150-031-Q1-E1-H1
tgatcagtgtcatttcacagcccctacaattcaaagatgatcgttcttgtggccatcctcagtctggtagcagtcagctcggcgagaccggaagctggatacagctacagcgctccaagtgctcccagcgctcctggaggaggttatccctccggaccatctgctccagcagctcagtatggagctccagcaagcggccctatcgtccagacgcatgtcgacgtacacgttccaccaccgagagactgacatcccagctccca

SEQ ID NO: 6474 - DNA, 147 bp, Diabrotica virgifera
  Clone ID: LIB150-031-Q1-E1-H11
acaacacctatagtgagtcgtattaagggcctttattcaatatatggatgtgatctatgacatctggttgcgtttactcaacatcaaacgcataatatagaccgtcttgggcgcacgtatcgtcgggatcgtctcctcatacacagc

SEQ ID NO: 6475 - DNA, 380 bp, Diabrotica virgifera
  unsure (1)..(380): unsure at all n locations
  Clone ID: LIB150-031-Q1-E1-H12
ctgtncngtgtgcacggtccggaagcgagctttagtatctgggtccgatgttctcgacatcgggtgcggagccgagaccgtcatgtgcgagacatattggggagagtctgttgaatcacacggcttctctgagaggcgcagctgttagcgaggtggtattacttttcgcgcaaaggcggcgacattttttaggcgactggaaaccccatgggggaacttctctgacgcacacgaaacaacgactgaaatggtccttctggaaaacttttctttaagcccacaaaactgctgtcactggttttgagtcaaaatgttgaaggaagcaatgaacatcctggaaagtatactgtaactaaccttgggaaagctgctttcgagat

SEQ ID NO: 6476 - DNA, 356 bp, Diabrotica virgifera
  Clone ID: LIB150-031-Q1-E1-H3
gataatgtccattgtagcggctatgcagttctaaagtatgttttagagtgcgtaattcagatctttcacgatgactgttgacacatgtcgatacccataagtctctgataagaccacacgcaagaacatcatggtgtatttattgagacctggcgctgaaatttctcagtacatttcaccgaaaggtacattgtagtagcatacatgatagtattgactgatataaatctcgtattagagatggtcaatacgattatctcgtaaaggcgatctatgacataggtacgataatggatgtgaatccattggttggatcacctattatcatccgaacattctgtaatgatcacacatgt

SEQ ID NO: 6477 - DNA, 333 bp, Diabrotica virgifera
  Clone ID: LIB150-031-Q1-E1-H5
gtggaactcgcgccaggtgtaacatctcaagtagtgttccttttagtctatgttgagtttcgatcagttgcatttactttaattcgacacgatcacgttgggtaacgactctagtcatcataacatctttgtcattgggcacgtgcagtctggtacagctacgactacgggacatttaatttatacgtgttgtggtatcaacaactatcccatctagttcatgcgatcaagaagcccagacattcgcatatccgctcagctctaaatatacctgggtacacgatcaatcttaactgtcgaggagagaacgtgtgtattatcaggtgatattgc

SEQ ID NO: 6478 - DNA, 452 bp, Diabrotica virgifera
  Clone ID: LIB150-031-Q1-E1-H6
tgaaatagatcatacaacgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcattttctgctaaaggtggtcacgttattgacgacttggaaaacaacatggaagaacttcttgactc

SEQ ID NO: 6479 - DNA, 208 bp, Diabrotica virgifera
  Clone ID: LIB150-031-Q1-E1-H7
tgcataaagtcatattatgtcttttggtgcgttattacgagtatgttactgtcaccttgtttattgcttgttattcatgattacgctgacgagatgccatcgatgatgcaggctttcagcgtcctatcaatctcttgcgtctccgctttggactcccattacaactgtcataatgacgcagttaccgcgtataatacagctgctgcgt

SEQ ID NO: 6480 - DNA, 431 bp, Diabrotica virgifera
  Clone ID: LIB150-031-Q1-E1-H9
attgaatcaactagacggtgatgtgttcagtaattgaatgtaaaatttaaaataatgttgaaattaatcaccttcatattcataatagtgaccgtcaatgcagcagaaagaatcaacaataatttaatttataaaaatgtggatagaaccatagatttaacgtcacagttagtaaaaatcaccagcaccataactcttgaaaatgccggcgcagaccctatcaagaattttctactggcggagcaaccaaatttagttgggcagatagcatttaaaggtgccaaagactctgccaagcaagatttaaacgtcttaacagcccaagtagaaaaccagagtgataagagattccacaaagttatcttgaggcagaatttggaaccgggccgtactgcaacagtggtggttgaagaaatactcattaaaagttt

SEQ ID NO: 6481 - DNA, 397 bp, Diabrotica virgifera
  unsure (1)..(397): unsure at all n locations
  Clone ID: LIB150-032-Q1-E1-A11
cagattagaagagcatgaacccattgtctgtaactgtacttttcgtagcagtcgctgccgccagcgctagcggtctccttggagccggtctcgtagccgacaaaggagccctcgaaggcgcactaagaggccaatggattcctgatgtaccagttgccggacacggacctgcaggtatcgtcgctcccggagtagtagcagctggagcaagtgccagaggtgccctcgaaggtgcccttggaggacaatggatccctgatgtaccagtagcccacggacctggtgtacttggcgctggtgtacttggagctcccggtctcgtcgcccctggtatccttggaggtcnccttggtctcggtcttggtcttggacccgtangacttggtcttggacccgt

SEQ ID NO: 6482 - DNA, 363 bp, Diabrotica virgifera
  Clone ID: LIB150-032-Q1-E1-A2
aggtaaaataatttttgttatgtaaatttttcaattaattgaagttgtgcaaaatcgtcataatagcatatttctgaatgaatccttatcatttttaagtaaccactacaacaggtcatagacgtctacagtggtgcttatctgcttatcaatcagttccaagtttgacgtttggattagtaaaacatgacagcaaaaattaattttcaggtaaaaaataaagatattctgcaaagtggtatatttaatcaaactttaagggactggcagagtatccaatgtgaaatcacagcgaaaaatttgatgtacccagtctttattgtggaagatgatgatgtcgtacaacccattagtagtatgcct

SEQ ID NO: 6483 - DNA, 386 bp, Diabrotica virgifera
  Clone ID: LIB150-032-Q1-E1-A3
ccaggtcgacgtacgcatcagaacgataggcacatcgcatttttgtgagaatcagtacttgagcggacggaaatgaaacctggttttaaaacgttatttgaacttcattaacctacttattaaaatcactacaaaaaaatttaaacgaacttaagttcaaacacgtgtatatattcaaccaaaaactgacgtttcctcgacgtaattgacgtcacttggttgcctgggtagtctcttactatatagttgacttcatctaattttgtgaggaaggacaaatttaatgacaaatcataaatttcgtatacatagaaaaatgaaaattagaaaaggccaaagtaacagaaacaaagttctgagatattctacaaaaacaatacattatc

SEQ ID NO: 6484 - DNA, 376 bp, Diabrotica virgifera
  Clone ID: LIB150-032-Q1-E1-A8
aacacgcgtccgggagaaccgatgtcagctaaaattttattatcaatacagcactgttactcataaggatcggaacagcaagcgaattatagatcataatgatcaaaataagatattgtctcaagaagaaagggagctcaagttcaagttaaagtatacacatagttgtacttagggaccgttcaagtattacgtaacgccggttgggggggggggggtcaaaaatcttcaaaaattgcgttacgcaatagttaaactcccataagagtgcgttacggaggggggtaggggggttaaaaatcttcaaaaatcgcgttacataatacttgaacgctcccttaacactttcagctcggggccaatatacatacttatc

SEQ ID NO: 6485 - DNA, 420 bp, Diabrotica virgifera
  Clone ID: LIB150-032-Q1-E1-B10
tattaatacagtaaaaaatattttgctgaaaaagaaagatttagtcaaattttaggtgtgtaaattattcaaaaggtacaaattctgcttaggaatttatataaggacaggttaagcacttcctacaatcagaactacaatatggtctatattaatgatgctagttcaaatgttttgcagtgattcccttagacacaggaaaattttacttcttggaagatgcttctgttttatatttgaatttttatacttaaaatgatattttgatagctatatcatggtgcaagtttaccattacagcaagtaaaacacattacagtctatttaaatcgtcttcaccaatgtttcccatgactatcttgaaacacataatacattgtgaaatggaacggaatgaaacaattggagatataaaatttt

SEQ ID NO: 6486 - DNA, 223 bp, Diabrotica virgifera
  Clone ID: LIB150-032-Q1-E1-B5
gtatgtagaatgtttttattgtggttacagtatgaatccaattccagtaaaatgttgcaatagcctctcattatttatcttttagttttttaactcatatttatatatcatcagaccatgtatgttactcacactgaaatgtagttccggaattggtgtatttaggtactcgtctagtactttatactgaaatagattttgtatatatacaagctcaaattaa

SEQ ID NO: 6487 - DNA, 52 bp, Diabrotica virgifera
  Clone ID: LIB150-032-Q1-E1-B8
gtgagtcgtattatgctgtcgtttttttgtttcatttgtggcgttttcgttt

SEQ ID NO: 6488 - DNA, 407 bp, Diabrotica virgifera
  Clone ID: LIB150-032-Q1-E1-C1
aatcgtttaattttcaatatttttttatgaaagttgtttcacatgtactttttataacaaatgttcagtagtaataaccagaggacattgataattgttcgaaaaatttttataacagatttcgaaagcttgttccttggaaacagaccgacgccgtaggcggaggtctgttgcctgtaagcaacaagcttgagaaagttgttaaaaaatttttgagcatttatcaatgttcgagggttattcggatagaaaattttttgctgatataaaattaataataatttcattaatattctcatcagtattacaaccaaatcgtgacattttgaaatattgaatatttgaaatgtcaaaattgaaatgaaacgaaatgtaggtatccatagctacatgattgactgaaaaca

SEQ ID NO: 6489 - DNA, 351 bp, Diabrotica virgifera
  Clone ID: LIB150-032-Q1-E1-C10
aggacacgtgggtaaagttacatcgaagaagccatgatttacctccatattatgctcatcactgttatgcatccctgaaataattccgagatgctgacgattgaagtaatgtttacttatagtcaatatctatataccggcgagactagactacatcaatagtttgcaaatgtataggatgcaccatgttcttcatattctatcacgatatcactcatcaatgaggcatatgggtaaactatttgaggtatcacttcatgtaactagataattataccctccgacatcattacctaattcttctccacgaagtagtctatgaatctacagtatgcctcatgggccatgata

SEQ ID NO: 6490 - DNA, 407 bp, Diabrotica virgifera
  Clone ID: LIB150-032-Q1-E1-C11
gtgagttttatacttaatagcatgtaccatacgatatgtctgttagcaaaggattagcggaaccggacgtttatgtctgcactttgtcaccagagacccaaagaatcgctaaggaggagctgcgcgaagacgagcatactcgtcaaaccgcgctggcctccatgcgagaatggatcatgcagaatccaaaaattaaactatgccggctagatggaaaattcttgctgcgttttttacgttttaagaaatttcacgtaactctcgcacaagaatgtcttgaacgttacatccttttgcgtcagacattcggagtcgcctttaactgcttggacatcacaataccaatgatgaacgatctaacggatttgggatacatgtttgcttgtccaaaaagagaccgattgggc

SEQ ID NO: 6491 - DNA, 401 bp, Diabrotica virgifera
  Clone ID: LIB150-032-Q1-E1-C12
accacgcgtccgcggacgcgtgggtctggacgtgcactttatagcacttgtcgcagaaagcatctaacccccaaacacgtatggtgatgtccaatttgcagaaaatgcactataatatacgatagtaattattgatttgtcctctttcaggtgaaaacaggctttttgtaacatatattttttattgtttgtaataggttaaaatgtacagtagacacttatatttaaaataaatattattttttatctatcaatccttgttgtaacatatggtaaggctgttcgtatttaaaaaataaaacaagaacatgtttttgaaaagttttgggcacggctcaagtattttattgtttaaatttaagatgaagttacaatgggcgcgcccgaatccgacaagatat

SEQ ID NO: 6492 - DNA, 338 bp, Diabrotica virgifera
  Clone ID: LIB150-032-Q1-E1-C3
gggtccagcacgcgtccgaattgaagaaatatcttcaactatctttacatggttcattgctagcataagagacatacatacctacgaattgaaaaatcttagtttctttcagtacactattctggtgcacagtttaaatgctaaccgcgtagatgtcatcgagagaagtattcgactagaagtgaggtatgaccaaatcctcccaggaattgtatccagtgagcaagttcgaatgcacggaagaaggaacttagatgcaaaggtgcaattagcttcagacgaactgcctcaggtattgatacatttaccgattccacttgaatctgatctcattcctg

SEQ ID NO: 6493 - DNA, 331 bp, Diabrotica virgifera
  Clone ID: LIB150-032-Q1-E1-C5
aagactcttgagggaagcgatgaagaacgtaggaaagtacactgtccctaaccatgataaagctgccttcgagttggagttgacgcgtacttcagcagttgaaactctagatctccagcgcgaagccgttgggcccaatcgttctgagtacggtgaacacagagctcagttcgggtctacggtggaggaagttatcttggcaagccgtactgatgatgcaatttagagagctgagggaggagacgtgactgcagatcgtgacgatggcagtcgagctattgaggagtaggcggatcctattgttagtcgtagtcgtgcagctttggagagc

SEQ ID NO: 6494 - DNA, 375 bp, Diabrotica virgifera
  Clone ID: LIB150-032-Q1-E1-C9
gggccgccaccactgacgatgacgacgaatgacaacgatgacaatgatgacgacaatgacaatgacaatccggttagtgacttatttgacgatgacgatgacgatgacgacaatgacgatgatgacgatgacgatgatgatgacgatgatgaaaccggcctggaggatgtcatcgaggcgaagagatcacgtgagtccaaaaaattaaagcatactaagaatgccaaaaaaatctaggaaacaccatcgccatcataaagttgctaacacaatcagataggtagttgacgtggagtagggtatagacactttattttcttctgttttaaagacctgatttctggaactgttcaaaggaggtttgacatgatggac

SEQ ID NO: 6495 - DNA, 307 bp, Diabrotica virgifera
  Clone ID: LIB150-032-Q1-E1-D11
gggtccaccacgcgtccgaaacattgcttgtagaaagccaagaaaggtggccggtcatttagtttagagacttattaaaatacaagcaagttaagtgaggctgtgagatcttgtggttcagtaaacatgaacaaattaatatttttagctttattagtgttcccagcagtcattttcattttcgaaaatggcaaaatggtatcgtatgctgaagaggaccccattgaggacgaagtagaagttgaaggggaagtggactctgatgttgaagcgacgactccagatgaagaagtggatgaagatacaa

SEQ ID NO: 6496 - DNA, 383 bp, Diabrotica virgifera
  Clone ID: LIB150-032-Q1-E1-D12
accacgcgtccgcatttgcatgacgtgtgagacgataagtggttaattattttaaataaatatctgcttaaaaaagagctcatttttgtgtttattgtgtatttggtggttggacaagcagtaaaggatgagatcgcttctatttcttctgcttttctatacctggcaaatctctttcgcccaaaagtgttcgagtccggaagtatcaagaaagttatcatttatttatagaacagtaccatcatctcaaattgaagtggtagaatgtttctatactgacggcaactcgaaaaatgattattacgatattaccaaaaactgcgttactgctgccaggaccagaatattcattgataaatatggcgacgattcacgtgttaatg

SEQ ID NO: 6497 - DNA, 411 bp, Diabrotica virgifera
  Clone ID: LIB150-032-Q1-E1-D2
gggtccacgcacgcgtccgaagatgttactcagatttctaaggataccgaaaataaaaacagttgcaatacccattagagaactgtctaatttaagcataggaaaagcaactactgctgcaaaatttatccctgtattagaaacatccacaagtactattcaaaatccttggatatatcgacaaaacgataacttcaatcttccgcgatgtccaaatttaaagatagatctcccaaatactatcaaaataatcatacctgcaatagaaccaaataaacaggatgtaattgaagcaccagcatttgatgatagtatcaagaaagaggcggtgaaaatgatcgtaatcaggaggaaaaagatgaagaaacataaactgaaaaaattgagaaagcgaatgaagtttgaatgggc

SEQ ID NO: 6498 - DNA, 413 bp, Diabrotica virgifera
  Clone ID: LIB150-032-Q1-E1-D6
atttttgcttttaatctcgtgaatgtaattctttattctttatcaattaagaaataatggttaatgctcaaaggaaattaaaataaataccagaaaataagcttatactataattatctagatttgtgcacctaaaattttttaaagatgtgtcctatatccggcttggttcagtttctgatagttcttgtaacagtgttgctggtatgtcatgcggtaatagtaaagagttgcaaggtcactttcaagcctaattctaccaaaatacacatgtatgattctgttcaagtcgcatacaacgtagataaagatcaaggaggcgagtatattcttttttccgaagatgataatatagcatcacttgacaaagaatatcttatatcgaaaataatacataaattggaaaggaattt

SEQ ID NO: 6499 - DNA, 186 bp, Diabrotica virgifera
  Clone ID: LIB150-032-Q1-E1-D7
ctcacgggtccacccacgcatccgaattgagacgttttgtttcttttagatattaatattgcagtatcaatgtatttttaataactaatggacttattacttgcattgcattatttgtgatctgtaaattaaacttggacaaataaataaaaacattaaaatataaaaaaaaagagtcaaaaataa

SEQ ID NO: 6500 - DNA, 163 bp, Diabrotica virgifera
  Clone ID: LIB150-032-Q1-E1-E10
accacgcgtccgaaaaaaaaaaaaataaaaaaaaaaataaaaaaaaaaaaaaaagaaaaatttaaataaataagaaaattgaataaataaaaactattatagactaactagaaagtggggctgaattcgaggatgttgtcagattgggataaaaagggggggg

SEQ ID NO: 6501 - DNA, 365 bp, Diabrotica virgifera
  Clone ID: LIB150-032-Q1-E1-E12
aacacacgtccgcccacgcgtccgcccacgcgtccggtagaaactacaaagactttagaaagttgttggttgttgtcttcatgcgaacatttaacaaatgtaacacatattgaaccaagaacgaccaaaaaaattagttatcaaaaatgaaaatatcggttttacgatgaggactgtgatagtgcttgtgtctttgtgcatatttgggtttcaagtatactgtcaagaagaagatggcccttaccgcggaaaatatctgggaaagctaaactcctaccaccatcaagtatctggagacatatatgcagtagatgattggactctgttgttgacgtcatttagttatgatggaaacggagcagata

SEQ ID NO: 6502 - DNA, 105 bp, Diabrotica virgifera
  Clone ID: LIB150-032-Q1-E1-E4
gcgtccgaagaaattagaggcgatgggttcgttaactttatgagtgatctttttatcgttagcggctttttcggtcgctgaaaatattgttgtgtgtagctacga

SEQ ID NO: 6503 - DNA, 246 bp, Diabrotica virgifera
  Clone ID: LIB150-032-Q1-E1-E5
cccacgcatccgatcccacgcgtccgcggacgcctggttcaggacgtgtttgtcaatttgggatctgaggacaggtatgttgcaagcatcttattatgatctatgttggtgtaccttgtgtatcatgggattattactagatcagtatatttatattattttcaattttatttgagcttgtaagttgacgattttagtgtcgaatcaattttttaaatagtttctttgtaataaaacgttatgcgt

SEQ ID NO: 6504 - DNA, 156 bp, Diabrotica virgifera
  Clone ID: LIB150-032-Q1-E1-E6
tacaataatctgaggtgagtcgtattaggtctgctgattaaacacatttgttggtgattggtttctgtagtccggaagtttcactcttcgttttatttaggtggatatttaattctttgtatgggtgcgtttttagttctgtgtgtttagaggggt

SEQ ID NO: 6505 - DNA, 156 bp, Diabrotica virgifera
  Clone ID: LIB150-032-Q1-E1-E8
cccacgcatccgagcacggtgtcaaatctggatgaattgggcagcagtccgtagcttaatttgacgaagtggctcgtggcaacgtcggacgtgtgagtagcgagagaagagctatctatcagattttcgaccggataggacggtcttgtacagtgt

SEQ ID NO: 6506 - DNA, 392 bp, Diabrotica virgifera
  Clone ID: LIB150-032-Q1-E1-F2
caacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacag

SEQ ID NO: 6507 - DNA, 421 bp, Diabrotica virgifera
  Clone ID: LIB150-032-Q1-E1-F3
gggtcccagcacgcgtccgcaaatatccaaatgtgtttggtttgtgttgattttataatatttacgattacaatatttatttaatttaatatcaactatggaatcacccttaaaaagtgaaaatgatacagttacagaagagaatccgtatgcttatttggatagagatttttcttcggagaattttaaaattgaagttaagaatatgcctaaatattatggaataagtgaatttcggaagcttctcaatgaaaaattgaaattaaattccaataaaattaaaacaactaaaagaaatagttcctttgcctttgtttgctttagaaatactgaagatagggacaatgcaatgcaagtcctctctaaatacaaatggaaaggaaaagaattgcaggttacgaaagctaaacctgcacctgat

SEQ ID NO: 6508 - DNA, 164 bp, Diabrotica virgifera
  Clone ID: LIB150-032-Q1-E1-F5
agattactttcaactaatcgataatatattggatctttagttatcagtcttggaatttgagcatgaatggtaagaacttccctttgaattttattagaatcatcactccgaacgccctgatctttaagtcgcacttgagatatttcttggggcatctttagaac

SEQ ID NO: 6509 - DNA, 445 bp, Diabrotica virgifera
  Clone ID: LIB150-032-Q1-E1-F6
gcgggtcgatacacgcatctgaactgacgtcgtgatatgatttaacttatatttgcttttgtagttattattaagttcctatattataattttgtgtgagctgtagaacatcgcagtgaattttgtgtatgagagaatgtgcgtgtgggaaatttgttcgttgtattttggagatgattcgatattatctggtgaaaaattgaagtttgattacatttgtttgacaaagatttcgataaaataaataactacacctaacgatatttttgctttgattacttaagcaaaatcggttaatttttaataaaataaagcttaaattaaccaagaaaatctttaaaagtagaaaatttttggtttatcgagtgttttcggagtttagtagttgacttaatgattcttcttgagaaatgtgttcaggattttttaagaacagaaatttagg

SEQ ID NO: 6510 - DNA, 423 bp, Diabrotica virgifera
  Clone ID: LIB150-032-Q1-E1-F8
ggggcatatccaaacagctattgtttcagattgcgttcataatcgtcgctgttacaatgtgttgaacagatacgagcgtggttaacggtaaaattgtctgcacgtttacgtttacataattgttttcacacacatcgcacctttttgtcttttgagaaactaaaaaacttgatattcgtatcgaaaccttgtgattgattgtccacattacaaccaaacacggcacacctcatttttaataaaagtttaacaaattataagtcaaattcaccttaaacaaaaaaataaacaccgtttactatacgacaacactgaatttaatgctgttctactcacagagtgacgtagctacgtaggccccgcccaccgactccatgtcatatcttcagttattgtatcatgggagcagtcgactcttctacg

SEQ ID NO: 6511 - DNA, 371 bp, Diabrotica virgifera
  unsure (1)..(371): unsure at all n locations
  Clone ID: LIB150-032-Q1-E1-F9
agcaatcaggaacaatacctgtttgtttagaggtacagaaattagcactacaactcgnccaacagacgtcgatttcggtagctgcaacgtcggatgcttctgcaataaagatcttccctacgatcccgctgagattgataaaatgttcaataatcaaccatataatataccgggaaaattcacatgcgccattttagattgtccagaatggttgggagcatttccccttcaaaaagattgttacagaaaatacaagttggaccaatgttgcgctgatggacaaatgtgccctcaagacaagcctggcaattgcgaagttgacggaaagacagtgttagaaggtcagcggttctacccanaagacacgtgta

SEQ ID NO: 6512 - DNA, 331 bp, Diabrotica virgifera
  Clone ID: LIB150-032-Q1-E1-G10
acgcgtctgaggtaaatcgtattataaaatgaaaaaaatataaaaataaaaaaaaaaacaaataaaaaaaaaaaaaacaattacaagattaaaaaagaaatacgacaaaaaaagggggggccggccaaagggttcaaactttatttacctgtgattgctacttcagaccccttcaaaagggcacacataaatttattgaccggaccgtcttttaaaacctctgagtcgggaaaaaccctgggttcacccaactaaacccctttgcaccaaaacccccttaccaaaaagggctatatcccaaaaaggcccgcacagattgcctttccaaaaa

SEQ ID NO: 6513 - DNA, 419 bp, Diabrotica virgifera
  Clone ID: LIB150-032-Q1-E1-G12
gcgtccgaaaacaatcatcatttagtatctagattaatattgttgattaaactattacccgtatacgcgccaatggagcatataaaattcttaattgcctgtcaaaaaatgcacgataactatctcttaaaacctatcaaatttcatttgcacatctcgacaggttttagagcaataaataaatcgccagtttgtaagaaaaaattcaacatcccgtatctcggaaacgaagcatgtgtggacctatgtctataaagcaaacgtcaaatggtagttgtcagtctttttcacagaaaaccgttaaaatagatattaaatgacgaaaactttatttattttgggaaaatcgtagtaaactgcatcatctagctaggacacttaattgtttcagatgattttaagatgattcaaatcctttt

SEQ ID NO: 6514 - DNA, 332 bp, Diabrotica virgifera
  Clone ID: LIB150-032-Q1-E1-G3
gcgtccgaggacacgtgggcggacgcgtgggtgagcgtgtgtacacgttcttgcgcatttgtttagtaattattgtaccactccggttgaaaaatcgctaggcgtactttggattcggctttcgagcgatagtatagtacagagaataggtgagcagtagtttagattctgtgagggagtttagaactagagttccagtttaggtgccatggcctttttcaaatcgatgtggagaccaaactcgaagcacgaaaagctttctgaagaattattttcaaagattaacaaagtcggccagtaataaaatgtacctgattatgatgccaatagat

SEQ ID NO: 6515 - DNA, 66 bp, Diabrotica virgifera
  Clone ID: LIB150-032-Q1-E1-G4
gcgtccggatctagatcgcgagcggtgtatctcaatgtaaatatattttgatatagatatttttag

SEQ ID NO: 6516 - DNA, 332 bp, Diabrotica virgifera
  Clone ID: LIB150-032-Q1-E1-G8
atgacattaaaaccagatggtatattcgataagcagtagtactataacatactggcagtttcgatagatacgttattgttagaagcaaactttagagcccaggaagcaggagagactggattcgtgcacgttgtcggtttgggattgggagtttggaagatttcacctcagcaagaaaaagtgtatatggatgcatttgccagtagaattgcaatccctggagagcaactaaatcacataagcgacatgtgttttgcctggatgtttcaagatgtatgcggcaactatgtcgatggagaacattcttccattccggaccatccatcatgcgg

SEQ ID NO: 6517 - DNA, 397 bp, Diabrotica virgifera
  Clone ID: LIB150-032-Q1-E1-G9
agcaacatggcagacatctcaaaagaagatcttcgcaaagaaattgccgccatcttaaaaaatgccaacctttcatcaacttctgccaaaaaggtgaaacaggacctaaaggagaaactagaaccaaatctacaatctaaaaagaaggaaattgacaatttggtaatggaattcgtcatttcaaaccaggacaagaaaaagggcggtaagaagaaggcagaatctgaggaagaggaggaggaggaagaagaagaggaggaagaggaaccttctgaagatgagaaaaagaaaaaacgccctccactggtaagatccagcaacaaagaatgcaaagaaaacatcagaagatgaatctgccagcgaacagagcgatggccattctgaagaagaatattca

SEQ ID NO: 6518 - DNA, 428 bp, Diabrotica virgifera
  Clone ID: LIB150-032-Q1-E1-H1
gggtccacgcacgcgtccgacgctgttcaatttaaagtcagttatactgtttacccttgttggtagcaccctcgtaacatctcgcaaggtgccaaactgggaagatgtttttcgagactaccagtcaaaagttgttcctctcagacattggggaaataaaagctactggatgggcaccagctttcaggcaacttggtttgaagcattaaccttttgcagtcaaatgcatatgcagctacttaccatcaactcagaagaagaaaattcagtaatttacagatacataagagaggccagcaaaggttttgaatattggacatcaagtacgagactaattgacggaaataagtgggtatggttcccctatggcgacttaatagaatacacaagatggtcaaacggtcaacctaatgatccaaatggggaaa

SEQ ID NO: 6519 - DNA, 375 bp, Diabrotica virgifera
  Clone ID: LIB150-032-Q1-E1-H12
accacgcttacgccagttcccttattatgaacatcgtgaaattttaacaaaacctgtttttacttcaataagtttcattcaattgttaaaatgatttctaatattttaaatataggttgtccttctctttatgactctcttatttcgtctaaggctcatggattttttatttcttcctctgatattttatatatattttcaggtccaatattttgtaccctactagtcagtacttttgttatttttcctaccgttggttttgcttttgactcatatagcgttgtggtattcttttggatttatgtgatttctttttctgatcattattgaattggtgtaattgatttctttcttctcttgtaattatagaccttt

SEQ ID NO: 6520 - DNA, 298 bp, Diabrotica virgifera
  Clone ID: LIB150-032-Q1-E1-H2
ttagagtcagttatactgtttacccttgttggcagcaccctcgtaacatctcgcaaggtgtcaaactgggaagaggtttttcgagactaccagtcaagagttggtcctctcaaacattggggaaataagggctatgtggatgggcgaccagctttcaggcagcttggtttgaagcattaaccttttgcagtcaaatgcatatgcagctacttagtatcagctcataagattgagattcagtaatttacagatacatgacagacgccagcataggttttgaagtattggacatcaggta

SEQ ID NO: 6521 - DNA, 212 bp, Diabrotica virgifera
  Clone ID: LIB150-032-Q1-E1-H9
accaagcgtccgctcactcgtaaactcaataccaaacagcctaacgcccaccctgaggtacgacaatggtcaaccgccgatttaaacgtgtaacacagctcgaagttatcaaaaatcagtagttttgggcttccttttaaaggtccaaatggcctgtgataaattggttgaaaaaatatcgacaaattccagaaaacttaactgctaagggg

SEQ ID NO: 6522 - DNA, 421 bp, Diabrotica virgifera
  Clone ID: LIB150-033-Q1-E1-A1
atttttatattattaatattaaatatttttaagctcatccctaaaaatatttaatattaataatataaaaatatttaattataaatatattgttaataaataaatttaatttatttcttaaaaaattagatatatttaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattagttaaatttagtaatgatgataataataataataaaaaaatgtatatttaataaaaatatatagggttaataaaagaattcgggaacaattttt

SEQ ID NO: 6523 - DNA, 348 bp, Diabrotica virgifera
  Clone ID: LIB150-033-Q1-E1-A12
tgagtcgtattaattcgtgagaccatgttcgatttcaggactggagcacttgtaacgtcattaactctgggacagcccatctcgcatttgaccatcgcctatggcgaggtcgcgctggacggttttacgtgggaacagcccagatcactacaactaaactgacaaccttccgtaacaatattttagagatcttttattgacgcactagatgcctccttccagattttaagtttaggacaaacttctgtgattggcgctctgaaccttgagaccgacgcgattttttgcctctctgaatcggtgtcattctacagggcatagtatcgcgtaccaacaggtaagggtcgc

SEQ ID NO: 6524 - DNA, 396 bp, Diabrotica virgifera
  unsure (1)..(396): unsure at all n locations
  Clone ID: LIB150-033-Q1-E1-A2
aggacgcgtgggtgtttttggtgtgacttttttttatcacgggttattttttcgtgtgttgcgctcatcgacataccacaagaatgaaacttatcgtaggattattagtagtagccacagctctggcatacccagtagcggaaaatgaagaaaaactagcccaaccagtaattgcacaagacgcgaagccagcagagcaagaactaccactaccagaccaacttcttcgcatatcagaaaaacttccccaaaagcaagaaccgttacctgccagcagcgattcttcatcagaatcttcctctgagagcagcgatgagtctggagaaaagaaatcatcctccgagtcgtcctcgagcgagaaagaatccagcgaagtanaaatccaagaaaagaaac

SEQ ID NO: 6525 - DNA, 389 bp, Diabrotica virgifera
  Clone ID: LIB150-033-Q1-E1-A3
gacgtacgattccgagggggcccccttttatttatttttttttttataaggtgtgttatgtttttattaaatatacaaatgaatgtttaatacgataagtataacagtgtaaaagctgataaattttttaaaatgcaaaacaatgtacaatattaattaatgtcaaataggactattgaattgaattaattttgaagttcaagaaattaaaaatgcaatttgtgtaacgcacatgcaaatacaaaaattaaatatcaggtactgtatttccgttgggctcttttcctaactacatttttttgaccagaccattacagaatattttcttaacgacgcgacgttcaacgttcaacgtattttaaaatacatttttgcctcatattaaaata

SEQ ID NO: 6526 - DNA, 400 bp, Diabrotica virgifera
  Clone ID: LIB150-033-Q1-E1-A4
attttgcattttttatatattattgtaatataaaataaatgagttaatatactcgtatggtatcccaaagtaaaaaatacatgtgtattgaatattatcgactttactacagaatttttttggacatctcaatgcatcctgcatcattcaaaattcactccattgcatgcgtagccgaccttctctgttctagttgaaatatcagtagtagatcattatttatataaacttctctatatgtactgttcctatttcaataagaatgtaataatatcgtttaactgacattcaagatattattttcgattattttactctcttacaacgttttactctcaaatcttcaaataaaacaacaggactaaagaaacactaacttaattttcataaaagcttcaac

SEQ ID NO: 6527 - DNA, 383 bp, Diabrotica virgifera
  Clone ID: LIB150-033-Q1-E1-A6
acgctgttgaagaaattaaatattggaagaaataatatgtaccaatgaaaataaaaagtctggaaaagttgatttttatacctatagataatatggaaattatggtggaggaattttggtcattgcaattgtactggtattttttattggttcacaattttcaaaaagttatactgataagattttaagcaactgggtaaatcacattcatcacaacacaacgaatatcaatgaagaaaatacagtgtgggatttttctttgaagatatattcagcgtttacactgtcaaccacgattctttccatattctcagcctttttgttacttaattttacaagaaaggcttctataaaactacatcgatgcttaagtaacactgtta

SEQ ID NO: 6528 - DNA, 394 bp, Diabrotica virgifera
  Clone ID: LIB150-033-Q1-E1-A7
taaaattattcaaatgaaccttgttcccgttgtttattgttaaaaacaatgagaagcacaatttatattagggctaaaacattaaataaattagtaataaaccgttttaatgtgacaagcaaagtaaatattttgggaaactgcaattgctacaatgaacccttttatcaaacttactcgtgtttaacacctagatctgtgatatttaacagtccagcgctatatcaatcttgtagatttcaaggcaccgatattaaggaggcagctaaagatgactctaaaaggtctgaaaaagagatacctgaaaaaattgtcctcaaagaaactctttcaagaaaggaaaagttaaagaaggctgtaaaagaatatggttcaactgttattgtatttcaca

SEQ ID NO: 6529 - DNA, 385 bp, Diabrotica virgifera
  Clone ID: LIB150-033-Q1-E1-A8
aaaccttgttcccgttgtttattgttaaaaacaatgagaagcacaatttatattagggctaaaacattaaataaattagtaatataccgttttaatgtgacaggcaaagtaaatattttgggaaactgcaattgctacaatgaacccttttatcaaacttactcgtgtttaacacctagatctgtgatatttaacagtccagcgctatatcaatcttgtagatttcaaggcaccgatattaaggaggcagctaaagatgactctaaaaggtctgaaaaagagatacctgaaaaaattgtcctcaaagaaactctttcaagaaaggaagagttaaagaaagctgtaaaagaatatggttcaactgttactgtatttcacattggaa

SEQ ID NO: 6530 - DNA, 414 bp, Diabrotica virgifera
  Clone ID: LIB150-033-Q1-E1-B12
aaccccaacaaggcgatttcccaccaaacccaatcttgcaacacatcgtacaacagattgttgcacagaaaatcatggaaagccaaaagctacgtgagcaacaaatgagagaacagcaacaacaacaacagcaacaacagcaacaaaaagaagtcagacctgaaccaacacaagaaattgaagaacgcccacgatttcttcagattgaacaaattgggcaaccagtcaatggacaaagattaccaattccagaagaagttttgactcaactgaacagattacccaaccgtgatgttatcgtagctgtatcagaaactgattctgaagatgctccccaagaggttcagtacgttcaagagcaaagacaaagtgccaacgaaatgaacggtagacaaacttatactagagctcttc

SEQ ID NO: 6531 - DNA, 98 bp, Diabrotica virgifera
  Clone ID: LIB150-033-Q1-E1-B7
tgagtcgtattaggtttcgagggtacagtctgagcgtcaattcaactcagtgatgtgtctcaactgtgaccaggtgaaggtgccgctactgcagacat

SEQ ID NO: 6532 - DNA, 394 bp, Diabrotica virgifera
  Clone ID: LIB150-033-Q1-E1-B9
tatagtgagtcgtattaattaataatggatatgacgatgtatctgacggcccccctacagattgataaaatttgtagggcctgtttatcggaaaaaggagatatgaggcccttatttggagcatgtttagatgaaatgttaaatacttttgcatcactccaggtctcagaaaatgatggctttcctcatcttatgtgtgtgcaatgtgtcctgcaatgtagcagagcttatactttcaaacagcagtgtgagaagtcagataatattctacgacagtatctatctccagaatttcagaaacaactgtcagatacgcttgccgaaaaacagagggaacacgttaaacaataattacaagagaagctacagttttctgaacatctaagtactgtca

SEQ ID NO: 6533 - DNA, 365 bp, Diabrotica virgifera
  Clone ID: LIB150-033-Q1-E1-C1
agccaaacggttagcagaggacacaaagagggctgattcggatgaaaagttcaaacgagtgatgggtctaatctgggcccaaatgatggacgctaacaaacagacagatgacaaagataaaaccccagatgtaagcattattgccaaattagaacacctgtctctagaagcttcgccaggaatggttcgcgccttgagcattattccatatgaaagccaaaagcgttttttagtaatgctcaaagacatcgtaccaacaacagtgctatcgaatgtagagtatgttgttgaaactgttaacaaagtaggtggtgctgtagtaactgtagctttagctagtatacaattggcatatgaagctattg

SEQ ID NO: 6534 - DNA, 128 bp, Diabrotica virgifera
  Clone ID: LIB150-033-Q1-E1-C11
agtgagtcgtattaaactgccagacgatgcgacagtaagcatgcgaggagcggcatgggacgtgtatctctgcagtttgccaccatagaagaatgagaatcgcgggggaggagctgtgcgaagacgag

SEQ ID NO: 6535 - DNA, 400 bp, Diabrotica virgifera
  unsure (1)..(400): unsure at all n locations
  Clone ID: LIB150-033-Q1-E1-C2
gggtcgacgcaagcctctataatgagtcgcatcatcaccactatggcattttttaagctagcgggtttgtttttgtgtaaagtcgcgtcaatcagtgcgttacccacggcacacgatgaagcgcgcggtaattcagttcanaccgaacacgatcttttggatgccgtttacaacgactgccttaaaaaagactctatgtcatgtctgaagtataaagtttttaatttcgtggacaagatgatcggcaacagggaaacaattacagtgatggatggtgttcagttcgtcaaaactcgcggtggtgaacaggatggtgctccacgcgctattagcagtgacgacactatcgaatctgtcattttcaacaggattacatcgttcttggggtcccatactttga

SEQ ID NO: 6536 - DNA, 240 bp, Diabrotica virgifera
  Clone ID: LIB150-033-Q1-E1-C3
tctagactgagtcgtagtacctacgcttggctcatcagtaaccgatgttcgtccacgttgagacgcatcacgccaatttgtgacagttgcagacgagcgagaagaggcagcgtacacagcatccaaccgctctttgatgtcgcagcgggatttcgcttccaaaatcatagcagaatttggaattggctgacattatgacaataaccgtgtaccagaacgcaataaatgagagtacacgtc

SEQ ID NO: 6537 - DNA, 324 bp, Diabrotica virgifera
  Clone ID: LIB150-033-Q1-E1-D1
aaaactttcaaattgcatgcaagccggattgcaagctgtaaaagaccatgcaatagacttgcatgaaagtcttgcatgcaaaaaaattgcagcaagttttcttgcaagctgtaaagcagtcttaaccattacctgcacgcgtcctggccctagtcccgcatgcccgcatgtgaactttctagtcttccatgcctatcttgatatatacgaaaacagtttctttcaggtatatatattctctcaacaattttctttacctcaatttcccaagaaatgaaagaacggcacattcgacctaatagtcttttaagccacccgtacaag

SEQ ID NO: 6538 - DNA, 439 bp, Diabrotica virgifera
  Clone ID: LIB150-033-Q1-E1-D11
ctcgcgggtcgatacaagcctctacactcacgtcctgacctcacgcgtccggttctaaagaaatttgcatccataaacgacatttagacttttgtcgcttattacttttggtaatcgaaaaatgttggcgattcatggcattgtttgtggttaacaccttcgctgcgtttagagatatttataaacttgcgtgaactgcgttacgacccacatatgtttaacaaagccatttaaaggctgcttgattcgaaaattaaagatattgttacgacagttctgtagattgatcctacatataagaaaaagttccttaaaatgggttggtacgtttatttgaagataccaatttatgcgctattcaagctaaagagagtcgccattaagcctaagatcaaccagctggctagaacaatcacatgataaaaggcataaacaaatg

SEQ ID NO: 6539 - DNA, 398 bp, Diabrotica virgifera
  Clone ID: LIB150-033-Q1-E1-D2
cacacgtccggcaacattaaaccatgttcttgaaagttttaattgccttccacgcggcggcagcactggtatcgatgtcgcaggcggtgccctccgacattcccgaaagccctttagcgtctccttgcccggaaacgtttacttatggaacgattgataaaccaggttattggacaggaaacctcatcttaagaccagatcatgacattagcggagtctgggtcaagctgatatttgataaggaagtggagaaagtgacactaaacagcgaagaattcataatcaaactctcggaggacagtaaaatggtcaaacttcaaagccccgatatgttattgaaagccgataatccagaacttttgggagtcactgtaaactacaaaagatctgccgtccct

SEQ ID NO: 6540 - DNA, 434 bp, Diabrotica virgifera
  Clone ID: LIB150-033-Q1-E1-D4
gggtcgatgcaagcctctaaattaagtcgtagtacaaggaattagtgacattgtccccacccaaggagtaaatactcttcgtcaatacgttggacaagttggagatgttatgccccttggtgaaaatgtacaatctggaatctacagaaactggaacctcgaccaagacttgctccaaaactattctccactcagacatttccaaactcttcttggacaaatccaacagcaacgacaacttcaacaaggtttattgagccaacagcaatatttacctcaacaatatttatctggagaatatcgtcttgaagatcagatgaacactaaccaaatcttgaaccaaatctacagacaacaacttggacaatctccattgaaccgttatttggtaaacatgagacttgtaaatggacaacaagtatacgaagttcctg

SEQ ID NO: 6541 - DNA, 341 bp, Diabrotica virgifera
  unsure (1)..(341): unsure at all n locations
  Clone ID: LIB150-033-Q1-E1-D6
gtgagtcgtattaantcgtattctgaacacttacagtggggttctagcgtgtgcaagcactgctgtcgtggtcgccggcagtgcattcggatattcctacaatcggtttagcgtcgcttggcgcagaaccatcgagggatggaaccactccttggcgggtttactgtccaggaagcgtcaacatatggccatatcatgtgatgagcggactctggatcgagctgatatgtactgacgagttggcgaacgtgtcagtaaacagccgcgcattcaggatcagactccctgaagacagtgcaatggtcatacttcaaagccccgatatgttattgatagccgat

SEQ ID NO: 6542 - DNA, 188 bp, Diabrotica virgifera
  Clone ID: LIB150-033-Q1-E1-D7
tcgcgtattgcgtaaaagtagtgaaaggtgtttggatcagtgatcaaatcttagtcatgtgatgaggaaatgaatatttatactacgtaaattagatgtctgatacttgcgtgttacggagtaggatgttgataattatatcataagtaatttcggctgtggtacaacagtggcattagtatatttat

SEQ ID NO: 6543 - DNA, 385 bp, Diabrotica virgifera
  Clone ID: LIB150-033-Q1-E1-D9
ctcgcgggtcgacacacgcctctacagtcactcgtactaataaaaaggaactagtcactggccgtcgcaactctacccgctggacgtagttgattcctacgacgttcttgcagtcgcgacagtgcaagcggtaaacgttgtaccataagccatcgtagacgtcttggcacacgacgtagtcctagacaagagtattagaaataatgagtaccagtcaccatgctaagacatttattcaaagatggaagaatccattctcttgaagatatcgaccagttctctatgccaatcaatgagttcgaaatcatcgatcatttccatggatcagacttgttagataacgtacagatgatcacacctgtacacatccatgctcttacttgtc

SEQ ID NO: 6544 - DNA, 419 bp, Diabrotica virgifera
  Clone ID: LIB150-033-Q1-E1-E10
tgttcatatatctttggttgtttatctaccatcgttaacttcaatcaaaacgcagttacgatttcaaagagaaggtgaaacattgtattaaaattaaagtgaagtaaaataaagtagaacaatagcattgtgaatcgttgagaaacagttgaaattcgaacaagtgatctatcattttcattatggcgacagaatacgtgcgtttcagcccaaacgcatttctaaattcgtttaatgcaaaactagaacaaccagtccgacaacatctcaaaaatgtatacgcctgtttggccatgtccacaatgtctgctgcccttggcgcagcagtccatctcttcaccaacatcatgcaagcaggatttctatcagcaataggagctttggtattcttcttcctcttagtaaacacacccgatgac

SEQ ID NO: 6545 - DNA, 404 bp, Diabrotica virgifera
  Clone ID: LIB150-033-Q1-E1-E12
attatcttgtcaagttttagcactgaatattagcggcatttgagttttatcaactttcgtcaatcgtaaataaatacttatcccgtttgaagctagttatcaagtttttacacaatatagaggcagataaaatacatcttgtgaactagttatctcaaaaacgtaaattttggagttatcaagttatagtactaaggcgacgaatgtcaatcggttttcattacttgccgaaatacattaattaacaacaatatgatcatagtgtattgagataacccggactcatactctctccacattgccaaagtgtcatggctgccgacattgtttacatatagaaaagttcctttttttctactaaaaatgtcgttttctgattatatgaatgaaataatcaacttact

SEQ ID NO: 6546 - DNA, 397 bp, Diabrotica virgifera
  Clone ID: LIB150-033-Q1-E1-E2
ttgtccatagtgctcaaactttaattttaatttttggaatatccatcactaaaccaaatcattaataatgggtggaatgacacagcgaccttggaccccaacaaagcgtcgtggccccatcgctgctgaattcaaaggtcctggaccagcatgcgtggcgttaccgtcctatataggaagaagaactaccgaatcaagatctgaacgagctccagcgtttagtttcggatcaaggcaaaatggaaaattagaaagcatcggcccaggtccgggtcaatataacataacaggaatgagtgcaaaaggtaaagacacacccccagcattaagcttacacagcaggccataagaacaaaagcctgaaaattttccggctcccggagactataatccagat

SEQ ID NO: 6547 - DNA, 313 bp, Diabrotica virgifera
  Clone ID: LIB150-033-Q1-E1-E8
atgcgatgcaattctgatctgctgatcaaacactttttttggtgattgatttctgtattccggaggcttcactcttctttttatttaattgaatatttaattctttttatgaatgcgtttttagttctgtgtatttacataagtaggattcatatttaataatgttatgcctctactttgaattcggaatcaataaacatatacacaaattagtattaaaaaaaaaaagaaaaaaaaaaaaaataaaaaaaaaaacaaggcagcaactcaagaaagaatatgcaaaaaagtataaaagttgaaattttatata

SEQ ID NO: 6548 - DNA, 418 bp, Diabrotica virgifera
  Clone ID: LIB150-033-Q1-E1-E9
accacgcgtccggtaatgacagacctgttgttcttgaccgtccaacatttgacctcccaacgtcaagagacagagatgcaaccgtagttgtcggaggtaatgacagacctcttcttgaccttccaacatccagagatagagacgcaaccgttgtcattggaggtaatgatagaccccttcttgaccgtccaacatccggagatagagacgcaactgtagtccttggaggtaatgacagacctgttcttgaccgtccaacatccagagatagagatgcaactgtagtccttggaggtaatgacagacctgttgttcttgaccgtccaacatttgacctcccaacatccagagacagagatgcaaccgtagttgtcggaggcaatgacagacctcttcttgatcttccaacatccagaga

SEQ ID NO: 6549 - DNA, 391 bp, Diabrotica virgifera
  Clone ID: LIB150-033-Q1-E1-F1
caccacgcgtccggaaaacaccgccttcaagatgctccgcgtacaatctcaggaagttagcacccaagaatattcagtggagacgacgacatatgaaacatacgaatatgaaaccactttctctgtctcggagacatcgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagacgaaaccagtgagattgctattgaggacaatcttgaacaaagtgtgttgaaagtgagcaacaacagttac

SEQ ID NO: 6550 - DNA, 377 bp, Diabrotica virgifera
  Clone ID: LIB150-033-Q1-E1-F2
agaatagacggaggcaaacgatgaactgattcagctggactcccatatggaatacatggacacaagggtctacggccagaacgacaatttggtaaaactcgaaagtgcacttacaatgcctccgtacatccaacttcaaactctactagagctttccaatcacgaccagattctcaattgcaatggcgtcactgttcaaaacatcgatgtccaggttaaaaatgagtcatcacatgtcaaccagcagacaattgatattggagcagtctagcagctaacgaacgagattcagcactgtaataatgtgaagacttgcgtaaccactacgactacattagcacctacggacatcatagtcactacgataacaacagtag

SEQ ID NO: 6551 - DNA, 368 bp, Diabrotica virgifera
  Clone ID: LIB150-033-Q1-E1-F3
acacacttcgggaaaaaacggccttcaaaatgctcggcgtacaatctcaggaatttagaacccaggattattcattggaaacaacgacatatgaaacatacgaatatgaaaccactttctctgtctcggagacaccgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccagtgagattgctattgaggacaatcttgaacaaagtgtgttg

SEQ ID NO: 6552 - DNA, 376 bp, Diabrotica virgifera
  Clone ID: LIB150-033-Q1-E1-F5
tacaacaccctaaagtgagtcgtattatagatcatgatgctcagctcaaaagcacctcgtgataccccacacgagtgtgcaatgggaatcatgacatatgccacatgagaagaataggaccattttcgctgtcgcggagacctcgatacgacatcagatcgactatcctcatagagatacgatcttcacattgtctcacagcggcagacatatacgacgacgaaagatgtatgtacgcatcatgcaaggtaaacctgatcgttattgttgcggtagtacacctcattaaccacagatgatgctccacactggattgtggtccagccagaccagaccagtgagattgctattgacgacaatcttgaacaaagcgtgt

SEQ ID NO: 6553 - DNA, 308 bp, Diabrotica virgifera
  Clone ID: LIB150-033-Q1-E1-F6
gagtgattcagctggactcccatatggaatacatggacaatagggtcgaaggccagaacgaaaatttggtagaactcgaaagtgcacgtaccatgcgtcgttacatccaacttcaaactctagaagagctttccagtcaagaccagattctcaattgcattgtcgtcactgttcaaaacatcgatgtccaggttaaaaatgagacaacacatgtcaagcagcagacaattgatattggggcactccagcagctatacagcgagattcaacaatgtaataatgttaatagttgcgtagcccctacgact

SEQ ID NO: 6554 - DNA, 276 bp, Diabrotica virgifera
  Clone ID: LIB150-033-Q1-E1-G1
gtgagtcgtattaactcacgacagtatcattgtggagtaaaccattatccggattaaggccacaggagcatcctgtattcatgattgcatgtcaagtagtgaacaattccaagctcttcaatcctaggctatttcaattgcgaaacttgacaggtctgaggtgaattgatttctcatcagtatggtggaaaaattggacagctcgtgtcacgtaatagacgcatgtgtgtggatacggcaaaagagtgaacgtagagtgggcggtggcagtcgatt

SEQ ID NO: 6555 - DNA, 435 bp, Diabrotica virgifera
  Clone ID: LIB150-033-Q1-E1-G10
ctcgcgggtcgatacaagcctctacagtgagtcggatacattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttg

SEQ ID NO: 6556 - DNA, 309 bp, Diabrotica virgifera
  Clone ID: LIB150-033-Q1-E1-G11
atagtgagtcgtattaaaaccgcctttgcgttgtggcctggcgcagccgggtgtcagcgtccagaccacagcaggaggtagacgttgtacaaagcgcgcaagttcgcccagcgcagtagcattggacgtcccgtgttggtgtccaaatggtcagtgataaattggatggaaagaaagggtacaattcggtgtcacgtacctgccacgggggaacagatcgacagattggcgctgtgcgttacgagctgaaatccaatgattaacctggagattttactataggaatcacccgtgtgttagaagcttaaa

SEQ ID NO: 6557 - DNA, 387 bp, Diabrotica virgifera
  Clone ID: LIB150-033-Q1-E1-G12
aaaattagtgccaacaactgaaacagtgacattagttcgagcgtagcaagagcggttgaattaaaaagtaacttccacacttccagtaacttcgtttttgtcagttcttctagttttatacaaagaaaaaatagcaacatgagtaaattcgttgttttattggcatgtttggcagttgttggctatgcctcagcattagaatgttatttctgcgacgattgtcaaggatctccaagcagctggccaaaaagagcttgtggcactgtccaacccgcagctggtatggaatgggcgtgttcacgaattgattacaaatccagagctacctacaaagatgccgtagacagaggatgcgcagcagtcccaaaggtgaatggaaaattaaac

SEQ ID NO: 6558 - DNA, 321 bp, Diabrotica virgifera
  Clone ID: LIB150-033-Q1-E1-G2
attgcgttaattaaattgaacacttttgtaagatatgaaacatgagtaagattgtcacgaattttagactagcgtagaaattaaccaaaaaataatcataaattttggaaaagtatttctgtacataaaagtatttctgtacagcgagattggaagtttcggttttattattgattctattataaaaacgtttctacaaagtcgcaaagtgtatttcattttttactgaaggaaaagttttgatgttttgtatataaaaagagaattaaatattcatcatctgtattgtttgatcaaattttgtaataaaatgttcatttt

SEQ ID NO: 6559 - DNA, 411 bp, Diabrotica virgifera
  unsure (1)..(411): unsure at all n locations
  Clone ID: LIB150-033-Q1-E1-G4
aatttatacaaaattttttgaaataaaggtttgcaactgttgacatttcagaatattggtatatacaaagtcaaacctatgagtaaaaatgctcataggcatgtatgtgcaaatgggtgcatacagtttgaatttgttgagattaaaatttttaaccattaaaaaacaaaaacaaaataaacataaactgacttaaatatgcttcaaaattcaaagtagtaataataaaagagatagtaatattgttctaatctacttacatgccgttacaaggattgcgttgcaacttagttgttgtcatattagtacgtccaaattatgctaattggtttgttgggatagtgatanggtaaacagacatgttacgtaggttaaaaacacagtaagatttcaaatttggaattgatcctg

SEQ ID NO: 6560 - DNA, 437 bp, Diabrotica virgifera
  Clone ID: LIB150-033-Q1-E1-G5
cgcgcaggtcattacaacaccctacagtgagtcgtattaaaagaaatactacagatcttacttgcaacacgatcacccagttaaccagaaattgtgcgacatacacacgtgaaagatcattgagttaaactgcagttaaccaattgaattgtaaccttgattttacgaccttcaatgattcaaaatcatgaagtccaaaataatagacgcggagaatctggagtcaccaccgttgttggtgataactagagaaggggctagactatattggggaaagtcggagtccgatgtatgtgacattgttaaggatcttcacgaatggattaaggaacaaaatttcccggaaatgccaacgaatcataggatagaattttttcttaccaactgcaaatgtaaaattgatgctactaaagatgttctcaatacatattagacaa

SEQ ID NO: 6561 - DNA, 309 bp, Diabrotica virgifera
  Clone ID: LIB150-033-Q1-E1-G7
acaataaacactgataatcggtcaaccgattgaaaactagttctgtttgttttatgatttagccctgtatagggattttaacaaatataccttttataaaggatttcatggttttttgtaataaatggtatacaggaaattttttcctcgtggatttgttaaccctttaacgtagagacgcatatattcacttgcatcaaaatgtacttcagagcgagaaacacattcatttctataaataattaataaaacgtttatcttgtgtgcttgtttattaaattctacactaacgaacttgtttaccacaaa

SEQ ID NO: 6562 - DNA, 402 bp, Diabrotica virgifera
  Clone ID: LIB150-033-Q1-E1-G8
acaatactctatagtgagtcgtattaatctgtcaaccgattgaaaactacttctgtatgttttatgatttatccctgtagaaggattttaacaaatataccttttacaaaggatttcatggatttttgtaataaatggtatacaggaaattttttccacgtggatttgttaaccatttaacgtacagacgcatatattcacttgcatcaacatgtacttcataacgagaaacacattcatttctataagataattaataaaacgtttatcgtgtatgcttgtttattaagttctacactaacaaacttgtttaccagattactcgagaaatgcatagatactcgggagtgttaaactgaagcgcacagaataacaatgcccaaacacagcatatatggggca

SEQ ID NO: 6563 - DNA, 255 bp, Diabrotica virgifera
  Clone ID: LIB150-033-Q1-E1-H11
tgagtcgtattatgtacataagcattaggattacaatttttcatattttaacatatgttagtatttatttttatgtatcattcattttaatattttagaagttttttgagcatgtataagttaattttagttagatttggtatggatggacatattggaattaacaaattgttgatacagtagcaatctgaaggtataatagacggactcggtaacaattatatcatctgtgtatgggaagcatgtctctttgtc

SEQ ID NO: 6564 - DNA, 125 bp, Diabrotica virgifera
  Clone ID: LIB150-033-Q1-E1-H3
gtgagggtctgtgcggagtttgcatcaattgtggcgattgtcatgaccgctcggatggctcaaaatgttgtgcgcattctaactccatgctttggagacgagggtccacttgggtcatttctgtg

SEQ ID NO: 6565 - DNA, 408 bp, Diabrotica virgifera
  Clone ID: LIB150-033-Q1-E1-H4
gcccaggtcgacgtacgagtccaagctaagtcatcacacggtctccatatgttctgccaatgcaagagtatgtgataacagctaatgtctcagaaacatacccaaaaaatgggttcaaatttagaatacgtcgattcatcacaagtttacgctaccagctacgtcagagattccaaagccgtacgaatgttatggggaagttttacgaaatgctacgctatcatcgctactgtttcctttataacagctgaatggattggtactactagcggtgaaacacccggaaaaactggactgtattcaaattgctacataggacaaaatgctgcacagtgcatcgagaagttttgggatacctttatcgaccacgctcatgctcttcaagcatccagggtgtctgtaagattg

SEQ ID NO: 6566 - DNA, 366 bp, Diabrotica virgifera
  Clone ID: LIB150-034-Q1-E1-A10
gtgacgcagcgcgagactttattatatcacgagttaagatttacgtgagttgcggacacctacatagcacagtgatagagcatatcatatgtttaatataaatatttagtgctcggacgttgtccgtcacggaatatgacgaaatacttaccaactaattaatgtcgaattcgcaacaccagcattacaagtacttctattgacagaccaacttcttcccataacttatggatgaccccatgttcaacatttgttaacagcctccaatttttcatcaacagtatcatcctcagttatcagcgatgaatctaggttaatatatacatccaccgattcctcctcgatacttttaaggatcgatcttag

SEQ ID NO: 6567 - DNA, 407 bp, Diabrotica virgifera
  Clone ID: LIB150-034-Q1-E1-A11
gcactcctggcactttgatgatgggtctcatcatggtaatcagctgatgaggtgtcaaggggtgtggttgtagagtgccctgttggtttcatattttttctgtgtaccgaactttcaataaagaaaaaaatacatagatacttacagatgattttccaacacttctgacgcatcaagacgtgaactgccatgttatatataatagtaacggctcgcagtttgctatggatgctcacgagtcttttttcaacactgctgatgttaagtgccttcctcagtccatcctggcttattgccgcacctgaaacagttcaattcggaaacgaaacagtaacttatcgacctagcgttggagtatatgccaaatgtagcaaaccgattggatttgaatatccaatttgtacact

SEQ ID NO: 6568 - DNA, 179 bp, Diabrotica virgifera
  Clone ID: LIB150-034-Q1-E1-A3
attaagccttaagtcgacgtcaatactcctccacatagactaccaagaattcaacctcacatggacgatcatagaatctcctcaaaaatcggaaccaactcaaggtaaccctactgattcacaataagacgatgtagaagaacaccacctgttcgtaatatggcataagtccaatgcag

SEQ ID NO: 6569 - DNA, 366 bp, Diabrotica virgifera
  Clone ID: LIB150-034-Q1-E1-A5
gtcgacggtgttgatcgaagacgagtcatgaaatttttgattgttgccgcattggtgtttggagcctgttcggcagaaccacagaggcggcctcattcctactatgacaaccaggctgaacaagacacaaacgtcccacaaaactaccaagacaactcagatcaataccaacagaattctgtccaacaaaacccaccgcaacatcaggaaaaatcgcaatatgaaccacgagtaaaagaaactatcaaattcataccaattatcagattcgataaagaacaaggagaagccggtaattacaaagctgcatatgaaaccggaaacaacattatcgctgaagaagaaggttacttgaaggaactcggt

SEQ ID NO: 6570 - DNA, 390 bp, Diabrotica virgifera
  Clone ID: LIB150-034-Q1-E1-A6
ccggttttaataccgggatcccggtatttgaaattttaaataccaaataccggtattgagattttagctcggtattgtaagccctaaagtcagtgacgttcgatttcttgttataaaaaaatcgatttttagtagttccaatgtgacacaaaatctaggcacgggattaaaaagtttatttgaagaaagtgtatttttttgtctttcttaatggcggtacaggctccatttctcaatattttatttagttatagagtaatttccagatactaacatatttctgaaattgggctctgtaccgccattctttattctattacgaatatgtgtgccaaatatctcgataaaatattcaaaattagagccgcaatcttggaacgcgtttgttgc

SEQ ID NO: 6571 - DNA, 391 bp, Diabrotica virgifera
  Clone ID: LIB150-034-Q1-E1-A8
gtttatattcgaaatcataaatttccttatttaatttaataattttgtaaatatttaatattgaaacttgtactagagcaacatggaactaagagatatcaattatgacaaaggagaatatgtagaaacggcttcaggtaacaaggtgtgtcgccaaactgtattatgtgggtcccaaaacatagttttacagggaaaagtaattgttcagtccgatgcaataattaggggcgatttagcaaatgttaaaacaggaaggtactgcattatcagtaaagaagcagttcttagacctccatacaaaaagttcagtaagggggtagcattttttccattgtcaataggagatcatgtttatataggagaaaaatctcttgtaaatgcagctact

SEQ ID NO: 6572 - DNA, 381 bp, Diabrotica virgifera
  Clone ID: LIB150-034-Q1-E1-B1
gggttattcagcgttctgcgcactcttattgttggcgaacgctgaagacaagtcatcggccacagacacgaaatcagcagagtctcaaaccaaggaaaaacgcggtttgtctctgggatacggtggcggtggacacgacttcggtggcggcggagatttcggaggtggcgactacgggggacatgattttggaggtggttacgaccaaggaggacaccatgaacaccatgagaaaacagtcacggtggtcaagaaagtagcagtaccttaccctgttaccaaggaagtaccatatcctgtagaaaaaacagtccatgtccccgttaaggttcacgttccacaaccatacccagttgagaaaaagggtacctatcctgtgaa

SEQ ID NO: 6573 - DNA, 363 bp, Diabrotica virgifera
  Clone ID: LIB150-034-Q1-E1-B10
gaagtactgcagtatttatatcagttaattgctgctatgagcttgctatcggttaactggtgagaatgaatactccgatgatctagagtacttcttgtgtcaagacaaagggggcattcttagagtagagcgtcaccgaaacagccgaccagaactcttgtcgtcgtctggatccgaggtacagtacatattcagcagcaagtcgaaccctggagatgtagaatgtgtggagattcacagcatcagcacagagaagttgaaaacaagttcatttacaacaaatctagatactatttttatcgtgcatggatggaacgatagccaagacgcatatgttaattctcatgtcagacaatatatact

SEQ ID NO: 6574 - DNA, 108 bp, Diabrotica virgifera
  Clone ID: LIB150-034-Q1-E1-B2
atattatataaaaataaactgttttattagcaataataacataaataaaaaagacaactgacaaatgacataaacatctacaaactcttccatcaaaagtaaaacata

SEQ ID NO: 6575 - DNA, 379 bp, Diabrotica virgifera
  Clone ID: LIB150-034-Q1-E1-B3
tttcttagaaaaattttgaaaataccatggactgatcatattacgaacgaaatggtgttgcaaaaaccggaggagacagagaacctttgaccaccattaaaaggaggaaaacagcatattttgggcacatacttagaaatgataaatacgatttgttatagctaattatgaagggtagcatagaaggaaaaatgggtcctagcagacgacaaatgtcctggctaaaaacattcgcggctggaccgggtttaacacacaggcgcttttaagaaaagcagaagatagagacgaatttggaattcgtcaaatgatggcataaatgaatattatgtacgttagaatggtacaaagacaatgaattaaccttgaatgacaggat

SEQ ID NO: 6576 - DNA, 383 bp, Diabrotica virgifera
  Clone ID: LIB150-034-Q1-E1-B5
cccaaaggtgacaaaggagaaaaaggatttacaggacgcgatggaacaaaaggagataagggtgatcaaggatttacgggaccctcgggacctataggacctactggtccccctgggcctgttggtagaagaggtttgcctggccaaagaggagacaaaggagagaaaggaccaatgggtttccctggagatcgtggaagagatggttctccaggactccctggtctttcaggtggtaaaggtactaaaggagaagcaggtataccatcggtaggaccttctggtccacctggtcctattggtgaaccaggagaaaaaggattacctgggttcccaggtaaacctggtcctaggggtaaatacggatttccgggattaatggg

SEQ ID NO: 6577 - DNA, 169 bp, Diabrotica virgifera
  Clone ID: LIB150-034-Q1-E1-C12
taaacatacaattttattaaaatttaatttttaaataaaaattaggattaagaattttcatattttaacatatgttagtatttatttttatatattactatttgtagtttttataaattttttattaaaatatagatttaaattagttaaatttagtaatgatgataat

SEQ ID NO: 6578 - DNA, 415 bp, Diabrotica virgifera
  Clone ID: LIB150-034-Q1-E1-C2
aggacgcgtgggcggacgcgtgggtggaaaacaacatggaagaacttcatgactcaaacgaaacagaaactgaaatggtcgttctggaaaacttttctttaagcccaagaactgctgtcactgttttgagtcaaaatgttgaaggaagcaatgaacatcctggaaagtatactgtaactaaccttggtaaagctgctttcgatattgagttgaagcgtacctcacccgttcaaactctagagctccatcgcaaaaccgttcagcctaatacatctgagtcttttgaactcacagctcaattccaatctaccgttttggaagttatcaacacaagccagactgaagatgcagtttttagagctgaaggaagagatgttattgaagatattgaagatttgattagaaatattgatga

SEQ ID NO: 6579 - DNA, 377 bp, Diabrotica virgifera
  Clone ID: LIB150-034-Q1-E1-C4
cccactcgtccgcggactcatgtgcaggtaacaacgtacataggagtcatcagcacatgtaatagtatggcagttcagcagcactggaacatgaaccacaatgttatggagatgatgaccccactagcaagcctagtaatgcgccttcaacacgtcaggcaatgtcactactgacgctctatgatcgaatggtcacactatcgatgcaatatgcgctcccagtgatatatgtgctgcgaataccatcagtacatgtcttatcacgcatgaccgtttcaatgtctccgctcgtgccagttctgtctcttgaccagcgtaacgcttatcaacagatatgcacatatatacgtattccattagttactaagggtgcaaat

SEQ ID NO: 6580 - DNA, 373 bp, Diabrotica virgifera
  Clone ID: LIB150-034-Q1-E1-C5
attcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaataagttaataattaattttaaatagttaataattttaaatttttaataaaattttttattaaaaatgaattttaattaattaaatttaattatgatgagaagatttatatttaaaaaatgtatatttagttaaaatatataggtttatataaaggaatttcggacaaattttttttaaccgtttatt

SEQ ID NO: 6581 - DNA, 249 bp, Diabrotica virgifera
  Clone ID: LIB150-034-Q1-E1-C7
gtttgatcaacttcaccacaatggcatattttttactagcagtattgaataagtttatttaactgatcgatcattactattgtcacagaacactttatttctagcggtgattcatgttacattcctgtaccttgcgtatcagggacgattacttcgtcagtctatatttagtatctacgtcttgactggagcttaaagtttataatttctagtgcaaaataatcagtttcaaggattcttttgtaatga

SEQ ID NO: 6582 - DNA, 57 bp, Diabrotica virgifera
  Clone ID: LIB150-034-Q1-E1-D1
ctgtcacataggcgtacactgtgttattaaaaaagaaaaaatttctgagtgaaaagt

SEQ ID NO: 6583 - DNA, 267 bp, Diabrotica virgifera
  Clone ID: LIB150-034-Q1-E1-D11
aaacggattaaagaacatgattgcacaggttttatttatctctacaattggagcgattgcccaagcaggacttcttcaccgtggtctagatttaggaggatcatcatatatcggaagccatagtatagctgttgcatcagaaccagttgtagaatattttgctcctccaaaatacgagtttaaatatggagtacaagactggcacactggccatgtcaagagacaggatgaatctacagtgggagaccttatccaaagtgactactc

SEQ ID NO: 6584 - DNA, 100 bp, Diabrotica virgifera
  Clone ID: LIB150-034-Q1-E1-D12
tacacctccctaaactgagtcgtattacgtttgacgtatcgtgtgaacgtcctaccagtttagaatagtgtgctatcgtgcagtattctgggagcttttg

SEQ ID NO: 6585 - DNA, 379 bp, Diabrotica virgifera
  Clone ID: LIB150-034-Q1-E1-D5
cccacgcgtccgtgctttttgcacgaaaatcacttccggaaaattaagaatgaaacctttgataacgctctggttcttagtccttgtagcagtggcgataaacgccgaggccaaggagaagaaaagcgcagaagccgatgacaagaaacagaagaaacgtggtctcctcagcttaggatacggatatggtggagattttgataatggttaccacttaggacaaggtggatacggtattgacggtggttacacactaggattaggccagctagacttaggacacactacttctattgagaagaccattactttggttaaaggagtaccagtaccatacccagtagagagacacatcccttacccagttaccaaacacgta

SEQ ID NO: 6586 - DNA, 238 bp, Diabrotica virgifera
  Clone ID: LIB150-034-Q1-E1-D9
caagaaagtttaagtgtgattttggaaaatgaaagtaactttactcaggatatttcatctaataacgttacagagagtgaatctgtctgcttcgactagtcaatgactgaaagtagaagtgagaaattggtagaaaatgttaaaagtgggataattgaagaagtaaataatgtcagggacaatgtgactgaaaatgtgggtttaaagacatgtgaaccctatagagaggtgaacaggt

SEQ ID NO: 6587 - DNA, 234 bp, Diabrotica virgifera
  Clone ID: LIB150-034-Q1-E1-E1
ggcgtcagtcgggagacgatgacgatgacgacgatgatgacgacgacgatgatttggatttaggagttgatgatgatgacgacgacgatgacgatgatgacagtcccgccgatgatgacgacgatgatgatgacgatgatgacgacgactactttggaggatttttagatgatattttaggcggtgacgatgatgacgacgacgatgatgatggagacgatgagcctagccagg

SEQ ID NO: 6588 - DNA, 392 bp, Diabrotica virgifera
  Clone ID: LIB150-034-Q1-E1-E6
acataaacaaatgtaccaactttaagatcctttatttgtctcaaaagaagattgatggaactacgcaggagttcctttcgcccaacaagtgctacaaaaccaagtatgcattgtcaaaagtgttttttgacttaccttgaggggcctgcatcatataatgttatttctaagccaactagatacacctttgaggacaaagtaaaagcaaagcagaagaatggcttacctcttacaagatatcaagaaaagtatctcaagagaatgaagaagtttactggaaatattttggtcactaaatgtaaattctgtaagcatgaaaagcatacatcattggataaaccaatgcgtaaaccattacccaagatatcactaatatccagtccattaataaa

SEQ ID NO: 6589 - DNA, 426 bp, Diabrotica virgifera
  Clone ID: LIB150-034-Q1-E1-E7
agggaagataagataattccagagcgatagatataaataagttccctcctgcagatgtccaaaataacgaatacagcggatcagataatcagaagttcttggataattcaattcgtaaaacttctaccaaagttttctcagattttaactttcagctaactacgccgagaactaaatatttcgatacaaaatatgaagaagctagacaaaaacttgaacaagaatacgaagagaataatccagaacactctgacgatcaccacatggatatcactcaagaagtggaagaagatgaccgtgaacatgatctccacatggatcgattatttggtagtgtcagaaataaccccaattcctctatagattacaaagaaaagactaagatctctcgtaacaataccgttgatgataattcagagcacaatg

SEQ ID NO: 6590 - DNA, 363 bp, Diabrotica virgifera
  Clone ID: LIB150-034-Q1-E1-E9
aaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatat

SEQ ID NO: 6591 - DNA, 370 bp, Diabrotica virgifera
  Clone ID: LIB150-034-Q1-E1-F3
attgttcctcaggagaacttctaaacactactaggaatccttcagaccactcagtagtctgagtttttctttatctagtctatcttgtatgaatcatgttaattcgatcgatgaagtatgtagtagatgcacactggcacgtgtcaatatatatcgtctagagtcccatacacgtgtttatagaataacgacagtcttgcgagtataatctcacatcaatgtacactcagatattctgacacgaggtaattttaaatattttagacggatagggcattacgataaatcacgttagcacacactatgtgtaggagcatgttaaatattcatgtcatgctttactcatatgttgaatactcttatagcacta

SEQ ID NO: 6592 - DNA, 416 bp, Diabrotica virgifera
  Clone ID: LIB150-034-Q1-E1-F4
ggattttaaaataataaaatattttttagtaaaagtaaagaaaaattttaattaatgatagttaattagtatgggagagaaaatttaaatttataaaacgaaaaaatttagggtttgtgtgcccctgtggtatccacggagggtataaaatagagaattattagatttaataattttcgacatttttaagagccaaaaaattaaaattttattggggaataaaaattttaaataaattttttggtgaagaaaaggtgattcccgctttaaaaatatccaaatttttaagaaataaattaaatttatttattaacaatatatttataattaaatatttttatattattaatattaaatatttttagggatgagcttaaaaataaaattttattaaaatttaatttttaaataaaaat

SEQ ID NO: 6593 - DNA, 397 bp, Diabrotica virgifera
  Clone ID: LIB150-034-Q1-E1-F5
aatgaaactaagttcatgtcagtaaatcaaacagtgtttaattgccattacatttatttgtcaggttttccatctctgctataaacaataagaaatgtaatgattatatacctcctcttccctttataatctgtttaagctgaacattattagttacctttgatgtatagtatatttacagttgcaaacacaaataggctcaattattccaagtaaatattatattctagaactgttttcaactagtattagacatgggtaattttaatagtgtagaaattatttttcattttataaaaaatataacaaagttggaatattcgtgtctttgcaaaacctatttaaaatacagatatttttatctaagagagaaacataacagctaaaagaagattat

SEQ ID NO: 6594 - DNA, 351 bp, Diabrotica virgifera
  Clone ID: LIB150-034-Q1-E1-F8
gacgttttgcacgtaaaccagcagtatcccgtcctcgtaaacaatcaggtagcccagcaggtttaggacgtcgtccattccgtcgtccatcttgcaggccaatgatacgaccagcccatctttcaggtcaaggtggtcaacatccagcgcaacaagagcaccacctagctcaacaacagcaccaccaagctcaacaacagcaccaacaaggtcctcaagctcgacaatgcagaccagcgcgcagaccaagaattgttatgcgccccgctgcccaacgtaaatccgttgctcatgatagatacacagttgctaatcatggaactcatgcttttaccgctcagatcgttcacg

SEQ ID NO: 6595 - DNA, 341 bp, Diabrotica virgifera
  unsure (1)..(341): unsure at all n locations
  Clone ID: LIB150-034-Q1-E1-G10
cttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaagatccaagaaaagaaacttgccggaactctcacagctatcagagagccaattaaggaagaagtgagggcaatcgatccacttcntgttttgaaaccaactgaaccaagtcaaccagatgttttaccagaagaacctaaactaatagattccgtagtggcccaaattgctggcaaagcgattcc

SEQ ID NO: 6596 - DNA, 422 bp, Diabrotica virgifera
  Clone ID: LIB150-034-Q1-E1-G5
gaggtggtgtgttttacgttcctccaaggagaatcaagttggaaatggaggaattcggcgacctatcgtcgttcgtttccccccaacggataatatccaatgctgtagatgaactcaatactccagtcttcgataaggatgcttttgatttcgacatcagcagttatcagacaaatgttcaggcgcacctcatgctgaagtgcgatgctgcgttcttccgcgaaaacagctcccttaatccactaaacaaccaagaggacgttttcatcaacccggagaacatgcatcgaaacgcagtagcatttaataatcaacaactatacactgacgccgatatttattcgcccacagcgtcagaaaatggtacatacattgttaaacagtccccgggcaactcatccatgttccaaatggacataaac

SEQ ID NO: 6597 - DNA, 380 bp, Diabrotica virgifera
  Clone ID: LIB150-034-Q1-E1-G6
aaaggtggtgtgttttacgttcctccaaggagaatcaagttggaaatggaggaattcggcgacctatcgtcgttcgtttccccccaacggataatatccaatgctgtagatgaactcaatactccagtcttcgataaggatgcttttgatttcgacatcagcagttatcagacaaatgttcaggcgcacctcatgctgaagtgcgatgctgcgttcttccgcgaaaacagctcccttaatccactaaacaaccaagaggacgttttcatcaacccggagaacatgcatcgaaacgcagtagcatttagtaatcaacaactatacactgacgccgatatttattcgcccacatcgtcagaaaatggtacatgcattgttaa

SEQ ID NO: 6598 - DNA, 242 bp, Diabrotica virgifera
  Clone ID: LIB150-034-Q1-E1-G9
catcagccggcgggtaaacaattttgacgctggtgcacaaatttttttaaacgtatttcttgaacaaagcgttttaataaaaactcgtagtttatattttttaaaagatttttgaaagttgggtgtgtaataactaatcagtgcatctatatactaatggctaaagtccaattgtgttacataatcgtgatggacaatcctaatcctatcatgacaccatttcagttcgaaataacttttga

SEQ ID NO: 6599 - DNA, 413 bp, Diabrotica virgifera
  Clone ID: LIB150-034-Q1-E1-H1
cagcaaacaccgtcttcaagatgaaacgatcccaacaagttaccgtcactaaaaccactacgacatatgaagaatacgaatatgataccactttctccgtttcgaagttatcgaaacttgagaatttcgttttacctcctagaactactatcttagcagtgtctcagagcggaggagacaaggaagaagacaaacagtatgtcgtcacgaatcacggaaaagctgatctttttgttgaggtgagacatctcaataaccaagatgatgctccacaatggtttgtagtccaaccagaccaaaccactgagatagatattgaggacaatcttgaacatagcgtgttgagagtgagcaacaacagttacgaacacgaagtgtcattttctgctagaggtggtcacgttattgacgac

SEQ ID NO: 6600 - DNA, 149 bp, Diabrotica virgifera
  Clone ID: LIB150-034-Q1-E1-H10
gtccagggtcgagcgacccgtccgaccacgcatccgtaatgtaatacctcaacagacataagcaccagtacaaatatatttcacagactcacgagcagttgcacctgttacagaacacagcacgtaatacaacagatcagttactgtta

SEQ ID NO: 6601 - DNA, 266 bp, Diabrotica virgifera
  Clone ID: LIB150-034-Q1-E1-H2
cgtccgaatttaaggccgacattgattgcatcggtatacgtctcagttttagcaccattttcacataagtattttacatatgaatcaatcatgtcgttaccatcttcgatctcagcgatttgtaagttgtatatcagatacatgtctgtagcaatttttgcactatctcgccactcataccaaaacattgccctctctcgttgtacctgtatagtataggagacaatctcgcaattggtaaagcttatagtgaatgccattcaatc

SEQ ID NO: 6602 - DNA, 301 bp, Diabrotica virgifera
  Clone ID: LIB150-034-Q1-E1-H3
aataatattacgattaaaatattgtttatatagtaagtatatataggtttaatgtaggaattcagcaacagttttgtcaccagtttagtgagagcatgtcttattgtaataaatttaaggtctcgcctgcgcactgagtatttcgagtagccgcggtatttagaccgtgcgatagtagcatcgtcattagtttagctattgaattctgaaatgaatggttggatgaatattttagtgactttatttgattcgtaatgaaattcatctttaagtttatcagcttaattatgtttaaaagtcg

SEQ ID NO: 6603 - DNA, 423 bp, Diabrotica virgifera
  Clone ID: LIB150-034-Q1-E1-H4
cagtattacgggtctaggacgcgtccgaccacgacgtcggcccacgcgtccggcttctctgaaatggccactgttgtttcatgacctcatggctgctgctcaagatacctttatcttgcaaaagatacgtgaggatgacttttctttgtttgtaatctcggaatgtctactgatttgcactgcttcacgattttttctataaatactaaagatttttgaaaatacttgagtcttttgaataatattgaatggctggtttcttggaacgaaattttctaccattacataatggaagaaattcaccacaaataatgcattgttaggctcttgtgtacatttcgcttcagttatacggaacttcatcatgaataagatataatgtttctcttcgagattttcctgccgcacttctccaaaaatcca

SEQ ID NO: 6604 - DNA, 394 bp, Diabrotica virgifera
  Clone ID: LIB150-034-Q1-E1-H5
aatttttgaaataatataaaatataattattaaacagaaaacatactgaaatatttgaaacaataattatataataaaatgacagaagcctgaactatttaaatacctttttaaacaagttgagaagcgaggaaaatgggtacacagcttttaaaatgtcctttatgttgtaatgaacatttttcttcccgtcaggatttaaagtatcatataagcgagttattaaatagtttgtcttgtccagtttgtactttagcttttaatagtgttattgaattagcagaacacctagacacggaatgtgaacttagtgaagagtgtaaccaaaatgaaactgatcctgaaatccaaatccaggagccttcagatccattgttgatcccagtggacgaat

SEQ ID NO: 6605 - DNA, 373 bp, Diabrotica virgifera
  Clone ID: LIB150-034-Q1-E1-H7
gtaaattctgtaatgggtggaatgcgtttagaattaaatttaatacgaataaaaaaatggacaaaaatcaaaaaaaaattattaaaaaagataggtgagaaaaacgaggtctggggtcagctgcaccccgcaccgccttacgacagttaaaacaaatttttattttatattatttttatttacttgttatgttaaaaatatctatttctaacaattattaaaaggatataaatttaaatgaaaactcgagggatacacgacaacaaaacaaacgctaaaataaaagataacagatacaaggaaacggaacaaatactaaaatataaccacagtatgtaattccgctggtatgtcggtacaactgttcttcttt

SEQ ID NO: 6606 - DNA, 414 bp, Diabrotica virgifera
  Clone ID: LIB150-034-Q1-E1-H8
acgatacaacaccctagagtgagtcgtattaggtggaatgcgtttagaattaaatttaatacgaataaacaaatggacagaactcagaaaccagttattagccaagataggtgagagaaacgatgtctggggtcagctgcaccgcgcaccgccttacgacagttaaaacaaatttttattttatattagttttatttacttgttatgttaaaaatatctatttctaacaattattaaaaggatataaatttaaatgaaaactcgagggatacacgacaacaaaacagacgctaaaataaaagataacagatacaaggaaacggaacagatactaaaatataaccacagtatgtaattccgctggtatgtcggtacaactgttcttctttcgtcgttacgtgccatctccgcaac

SEQ ID NO: 6607 - DNA, 294 bp, Diabrotica virgifera
  Clone ID: LIB150-035-Q1-E1-A1
aagtgagtcgtattatgcaggatttcgacggtagacgatggtgacgaaggaggatgaataggatgatgatcaagctagtgatggagacgacgaaccgctgatacagatgatgcagaggaaactgaacgagatgaagatgatggaactgatgatagcctcaaagccgctgatactagccagagaagtagaaggaccgatggaagccgagcaaagacatggaccacaagctgagggataggaagaaggaacgaaagcactgtggatagttctgggatggccgtgaaaattggtgtt

SEQ ID NO: 6608 - DNA, 391 bp, Diabrotica virgifera
  Clone ID: LIB150-035-Q1-E1-A10
aagacgcttggcggacgcgtgtgaatcgctcgtctgaactgggtatcattttggccctagtaattttgttgacggcagctcggaaaagggatgcataggatcggttaaaacattctctcgggtttctaagcgatgacgttcgttttcacgcctggccctcttccttctacgttgccatgtattattaaatgaagtataatatatctcattgggtgtcgcctaatatagccaaaatattcaagtttgcgattttggaatgttctaacaactttcgtaactttttccatccgttgtaaaacaactttgtgacgaacgctattatactcgtaagattctccagaacacacatatttcaaaggctatcagttttttgataagtgcttcgttaagt

SEQ ID NO: 6609 - DNA, 413 bp, Diabrotica virgifera
  Clone ID: LIB150-035-Q1-E1-A11
cacaaagggtcttaaacggactagagaaactactgaaaagaaaaaatccaagcacaaaaagaaaaagagtagttatagctcctcatcagattcacaatctagctcagatgaagggtatatgaaaaagaagagcaaaaagaataaaaattatgaatatagttccagcagtgattcttctgatggagataggagtagcaaatataaaagaagttcttataggtctagatctagaagtcctccttataagtccaatatggaatcccaagaaagtaagctacaaaaacaagaatcgagtgcacaaagagaagaatggatgaacattcaaactaaatttttaacatcatctaattctgatcgaaaaaaggaaagggatgagcagaagaggttagaaagggaaaaacagcagtatgatc

SEQ ID NO: 6610 - DNA, 404 bp, Diabrotica virgifera
  Clone ID: LIB150-035-Q1-E1-A2
ggtcgaggacgcgtccgaggacaagtggcggacgcgtgggaatcgatcgtcggaactgggtatcagattggccctagtaattttgttgacggcagctcggaaaagggatgcagacgatctgttaatacattctctcgggtttctaagccatgacgttctttttcagcctggacctcttccttctacgttgccttgtattattaaatgaagtagattatatctcattgggtgtcgcctaacatggccaaaatattcaagtttgcgattttgaaatgttctgacaactttcgtaactttttccatccgttgtaaaacaactttgttacgaacgctattatactcgtacgattctccattacacccagatttcaagggctttcagttttttgataagtgcctcgtta

SEQ ID NO: 6611 - DNA, 394 bp, Diabrotica virgifera
  Clone ID: LIB150-035-Q1-E1-A5
gtgatgaaggtcaggatctcgacgataaagatggtgacgaagaggagcaagaggatgatgatcaagctagtaatgaaaacgacgacaccgctgatacagatgatgcaaaggaaactgaacaagatgaagatgatggaactgatgataacgtcaaagccgctgatactaccaaagaagtaaaaaaaccgaaaaaagccgagcaaaagcaggaaccagaagctgagggagaagaaaaagacaacgaaggcactgtggatagttctggcatggccgtgaaaattggtgttggggtagctcttctagtggtcgcacacctcgtattgattaaaaaatggagaaacgctgaggatgaaatcctgccaactgaaaaagctcctccaaatatacaagacag

SEQ ID NO: 6612 - DNA, 343 bp, Diabrotica virgifera
  Clone ID: LIB150-035-Q1-E1-A7
atcatttgtagacactatttatctgatgcatgtttcatttagatcatttaacctatgcgctctatgtagttttttgatgtcaaattattgcattagttagtttatgaatagattttgaacatgatggtagtgcctacgcttttaagcatctgtgattaaacgcatcactgctcaactacaaatttttcattaaggtttatataggaaatgagtcttttatgtgctatagtgagattttagccgtcgctgtatatccttcgaacagattttttttatcaagtgaagtcttcacattttttctacttgtaggtacttgtagagtcaagaatctggcgtacagtag

SEQ ID NO: 6613 - DNA, 429 bp, Diabrotica virgifera
  Clone ID: LIB150-035-Q1-E1-A8
aaaaaatagcagcattttgtcagaatccaactttagtggaatgtcggcaagaagaatgtagaaggaaatgtctcgagttctggaacttacctgataaatcaaaaacggcactacctcagcttagcgcacttcagcttgtcaatttagttttagataaaccagaaattcttttggtgcaacccagaaaagttgaccatattgaagcatttaacgaattgatctcagacgtggaagattggtattattttccattgtatagttctcagaaaacaaataattgtaacttctatgctggtgtttctggcaaggtttataggttacaaaaaggaaaatggataaaaataaataatatacaattgtgcagaggaaccttgttgtacggcgaatttgtcaaagaaaaatgtttaacaacggaaggaagtaaagaaa

SEQ ID NO: 6614 - DNA, 404 bp, Diabrotica virgifera
  Clone ID: LIB150-035-Q1-E1-B1
gtaagatcatcatttttatacattatttatctgagcagtgtttcatttagatcattttacctagtcgttctatgtagttttttgttgtcaaattattgcaaacgtagtttttgaatagatttttaaaacgattgtagtgcctacgcttttaagcatctgtgattaatcccaacaatgctcaactacaaatttttcattgaagaatatatagaaaataaatcttttatgtactataaaaagattttatccttctctgtatatctttcgaacagattttttttatcaaatgaattcttcacattttttctacttgtagtacttgtagagtctagaaactggcgtaaagtaaaaaaatatgcaaaaaaattattggtgcttagatttccgtattagctttgtttttg

SEQ ID NO: 6615 - DNA, 371 bp, Diabrotica virgifera
  Clone ID: LIB150-035-Q1-E1-B10
aaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaag

SEQ ID NO: 6616 - DNA, 350 bp, Diabrotica virgifera
  Clone ID: LIB150-035-Q1-E1-B4
actgatgttaaatattttattgctaataatctcttgcgttttgataacccatgcaacagctgacacatgttgtgcagctaatccaaaaaatatttattatttatgagacaaacaggtaaattgggctaacgctgtgctagcatgccaactcgttggaatgagattagtaagtatccagagtcaagctaagaatgaggaaatctctgcatttgtgcgaacctcatgagtgaaaaatatatgaatcgataacgccatatggacttcaggaaatagacgccagcacaaagttcattggctttggttagctcaagaagctcttgtgtacacgacttgggacctggtctttcatg

SEQ ID NO: 6617 - DNA, 416 bp, Diabrotica virgifera
  Clone ID: LIB150-035-Q1-E1-B7
accacgcgtccgaaaaaatgtcaatggtatatttttaatttccctgtacattcctcacgtgtggtggtagctttagaatatcgagatacatcttatttctactgctgtggaatcagaagtcactaaaaaataccgcttgcttctttgataactttgaaattgtatttatttatcgaaaattttgtctaatttgttgtcttggatttttggtaaccaccatttacgtgcatcttttcttgattgaccttaaggccaacttccctggcacctctttcaaaaaggataacttcttttgcatctctggtgctttgtacaattgtgtcgacatcgtcagcaaaacctaacagtactttcgttcactgggcagcgaagccatttgataattctggttgtgctttcgtagtgtgtttcaaagc

SEQ ID NO: 6618 - DNA, 402 bp, Diabrotica virgifera
  Clone ID: LIB150-035-Q1-E1-B9
cccacgcgtccgcaacaacccttctttggtttctattttttttcggtttagaattttcggagatttttcttcgcgggtttttgtgttttatgaagataaattttaacagattgaatctgttttatttttaagaaattttgatttaagaagaaaattggatttaacaatgtgagaagtttcaattaaatatgtggtttttttaaatacatagatcttatcttatgtgaatgaaaatgaagatggtaaagtgaaaatatatttaaataactgatccatccaatccgtcctcatgattgaaccaacagacaagaatggacctaataaaatcttattacaaccgctaccagccctcttggtccgaccagttccctgctacatcattcttccctcaaatagatccgg

SEQ ID NO: 6619 - DNA, 409 bp, Diabrotica virgifera
  Clone ID: LIB150-035-Q1-E1-C1
aaacattgtaaatttgtattgtaatttgattaatttgatactttgataggttgcggttaagggttaaaaagtcaaaatgaaacatcaaaaatacaaagtttttacattgatcaagataaaatgtgataaaagcgacagtagagataattaaaacacattattcatatttcctcgtggtttcaaactgaaatttaatggaaggagatttttttagaataaataacttaaaaccaagaccaacaagcagcatcaatggtctttggatacaatttttacttcgactttctgtaattgtttctgtcttcaagcactcaattacttcaacacctacttacaaattagcttcattaatatgtatgggcatgatagttgtctctttgataatatccatgcagaaatattgaaagca

SEQ ID NO: 6620 - DNA, 403 bp, Diabrotica virgifera
  Clone ID: LIB150-035-Q1-E1-C10
accacgcgtcagctatattgttgacaaatgatgctgtggcatactgaaggaatcactcaattcggcaagaggtttgggaagtgcgaaacatcaatagtgtcccattttttagaaggtacgttgagtgtcgtgcttagtgtagtatggtatctatataatttgtgaatcttagacgtcgatactaatgtaaggtgccactttaatatatagagttatatacaatccttttacttatacactgctggacaacggctacgaatgcaagcataatttagtcattttcaccaagaaattagtgaaattttatattagccaagggccgatcaaagttcaatgtgtttcagagtgtattcttattaagtttgacccgctgttaaaatttcttccacttcttcttcttcat

SEQ ID NO: 6621 - DNA, 231 bp, Diabrotica virgifera
  Clone ID: LIB150-035-Q1-E1-C3
ggtcgagcacgcgtccgcaataaaggaatgattcatagttgtgataaccaaatttcgttgtgttgtgaatttgatattttcaaataatcagagataatatttcaagtatatattaataaactgtaatacagaatattataggcaactactaataatttgtggaatatttacatagcagttgttgggccatatagtcatacatacatttacaatacataatgtaaggtgagc

SEQ ID NO: 6622 - DNA, 407 bp, Diabrotica virgifera
  Clone ID: LIB150-035-Q1-E1-C4
accacgcgtccggaaaatttaaactattagaaataattaaattaagtaattgttaataataaaataaaacaataaaatggataaaagtgtagatgtcgaaattatactcactgaatacaatagcaataccaccaagaaatcaatagttgccgtagtggaaaactatttgaaaaataagatttttcgtccgaatagtgtaataaattttgaacgcgaaaatacaaacattcttcatggggttgttaagacagttataataggagagattgcaggttatgataaatcctttgtagactttaacaacttaaacatcaactggttcgtttataaactagatgctgaaggacctctcttacaaaatgaagaagatggtgaagaagaagtcacgatatccacacaactaatgc

SEQ ID NO: 6623 - DNA, 331 bp, Diabrotica virgifera
  Clone ID: LIB150-035-Q1-E1-C8
ggggccaaccaaacatccgaccaagcgtccggggattattaattaataaatatatatttaatattttcgaatttaaaagagctaaaaaattaaaatttttaatgtaaaataaatattttaaataatttttttgtaatgaaatggtaatcgtttttaaatataaccaaatttttaagaaataaattaaatttaattattaacaatatatttataaataaatatttttatagtattaatattaaatatttttagggatgagcttaaaaataaaattttattaaaatttaagttttaaataaaaattaggattaaaaattttcacattttaaaa

SEQ ID NO: 6624 - DNA, 380 bp, Diabrotica virgifera
  Clone ID: LIB150-035-Q1-E1-D10
cttggttggtaaatgtaacatctgttcactaactcctgttgtttatcacattgttgaaaatagcatacgattgctttcaacagcaatctatgcttgtagcaaacatataatttaagtttattattttagttttctagtgtgccattacttttttccaagatatatagatataacttttatatatattttttagttaataaggttgtttctaggaacttagaattagatgtcaatgaaatttttgatgtcaaattagtcccatcccttctgtcagaagttatttccttaatcgtgtattagtatcctaatattttagaagtatttgatattaaactaggtaagatacggcttgaacaatgaatattggaattaatggaaat

SEQ ID NO: 6625 - DNA, 207 bp, Diabrotica virgifera
  Clone ID: LIB150-035-Q1-E1-D12
acgcgttggacgatacaaaaccctaaagtgagtcgtattaaattcacgtaccacagccttataccgttgacaggaaagtaccagtgcctgttaaagtaccagtcacacaagcctacactgtctacagaggagttccttagccagtcaatgttgaagttccagttccccaaccttacagcgtagaggagaaggtgacctagagaagtt

SEQ ID NO: 6626 - DNA, 400 bp, Diabrotica virgifera
  Clone ID: LIB150-035-Q1-E1-D3
attacttacttggcactttgctaaaatcaatgcacaggacgaagaatgttgcaacgcgtactcacatgccgatgcaaaagaaatggagaattttttgaaacagcaaggctgcaccgaattatcaatgaaaccagtattagcaaatagaaccaaattcattttgagcaaaccaagtgcgtccaacgaaagtggttcacttgcacgtagatctcaacccttaccacccaccgatatgttcgatcacatgcctgccagcatcatttaattttttagtttgtcttcattctaaattaatcttcgtcattagtaattagtacaagtttactttgccttctcggaacacacgaaattgttgtcgcacttgttttggtgtgaaaaagcgtgtttcgaagtcagtttg

SEQ ID NO: 6627 - DNA, 422 bp, Diabrotica virgifera
  unsure (1)..(422): unsure at all n locations
  Clone ID: LIB150-035-Q1-E1-D4
agacatagaagagggaataatataggaaaactgaaagaactttagataccaatccaacaaacattggcccaagaaattaaagaaccaatggaagaatcctaaaaacgtaaaaacgaatgaaaaggtacattaaggaagaatatttgaaaaaaagacttgaaagagcagaggctcagtacaagtaccaaataataacatagatggcgtaggtgacacgagcgtagaacggctacagaatgaataacatgacaaatgatacagtacaggtacacagtatagacatcacacgacagaacagaaaaccacagaacgatgacgtaaaaacagacatgatatgacatcagacaattgacagatgatgtcagcctcgccatcttgaaanggggagtggctaataataggtaccatcgaaatagttacag

SEQ ID NO: 6628 - DNA, 421 bp, Diabrotica virgifera
  Clone ID: LIB150-035-Q1-E1-D5
tgtttatcctgtcatacccaagaagtcaatgtttttttttgttgttatcgaaaactgaattggtaatccagtttcctctcttccgaggaggctattgtagcagatggatttctactacaatattttataaaaaatatccattaattttaatcctatcccaagaaaaatattaatttttttaatatattttgcgagtttatatatctttaaaatttcctaagccgctcctgttcgcattgtaaaggttaggaaatttcctatttatttgtgtagcaataaccaactacgtagattgttattgaaaacatccattattcgagaatgaatcctctaaaaggttcagtgtttttcctttaagttttgagcgctaaaaatcccatgttattattggtctgcattttgaaagatccttgagttgtag

SEQ ID NO: 6629 - DNA, 425 bp, Diabrotica virgifera
  unsure (1)..(425): unsure at all n locations
  Clone ID: LIB150-035-Q1-E1-D6
tgtatttcctagttaataattgatttcgttgagttttaatgttatagtcgttattaggaagattttttttatgattttacgttctcgtgtgggaagtggttagaatatactgccacattcttctcgcaggtttcttgcatgctttaaaaatataaacaaattttcaatttcgtttaaaatgaaatagatctataataaaaaatattcacgaacgatatacaagaaatggttgaatataactaaaattatagaaatatttatttttatatattttttagaacagcatattttgccaattctctatttattttctctctgttatattttatgttaactcgaatttgttactgagttgattttagacgaatgattcaggtattagtaattactaaatgattctaacgaaatttaggtanaatacaaat

SEQ ID NO: 6630 - DNA, 143 bp, Diabrotica virgifera
  Clone ID: LIB150-035-Q1-E1-E10
cgttggaccacatacaaaaccctaaagtgagtcgtattaacatttcagaacttgtgttcaaactttggattgacatgcacagaatgtgtactgtgcaagtatcaatccagatcatcctggagctcttaatggattggaacatg

SEQ ID NO: 6631 - DNA, 433 bp, Diabrotica virgifera
  Clone ID: LIB150-035-Q1-E1-E2
ctgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaacagaaac

SEQ ID NO: 6632 - DNA, 321 bp, Diabrotica virgifera
  unsure (1)..(321): unsure at all n locations
  Clone ID: LIB150-035-Q1-E1-E5
attaaacggcattgtttgactgacattgctttaaggaccaatttgatagtagaagtcgttaataatttaattcagagatatttcgataatttcgttcaatgataatatccttctataaatgaattatttagtttgtggactatgantaacatggattaacaattgacacttatatatttactatgttccgattatgactaacgtgtgttgtaaaatttatatacggaatgaattaaattaaaacaattttgtgttcacaaatgataatcgtgtttaaataaaaccaacttattcaataagtcagttaatttaattaataac

SEQ ID NO: 6633 - DNA, 354 bp, Diabrotica virgifera
  Clone ID: LIB150-035-Q1-E1-E9
aaaatatttttcatccaagcgatattttgatactacatgtatttgctacttgttctggtaatcccaataagattgtttatttttaaaaatctgtcccgaaaagtgtaaatttttaattgatttttgggccccttaaaaaacggggtgctaatttaaggacgaataatcaataaaataatttggtcctaaattgaaacccccggttttttaaaattagaacaatttacaaggtaggtaaacaacagttgaaacttagttaggtacaaaccgcctttaaaaaatttttccttaaattactaagaggcattggaaattggaaaattttgggattttccaaggaaattttgtaaattg

SEQ ID NO: 6634 - DNA, 428 bp, Diabrotica virgifera
  unsure (1)..(428): unsure at all n locations
  Clone ID: LIB150-035-Q1-E1-F1
aacgttagaatcagtgtgcaagcgggtttgccatatgtcgcccattctgtgaattatcataaataaatcctccttttgtatttcacagcagttaacagcgataatcctctacaaggccctgcctaattctacctttcaaggccgctgccgtgaagggcggcaacgggtgtcaggaaaattgtcatttggtttgcatggccctatccttcgtacactgaatcgcatgtctgaaatacgctgtagaattgagtagttattgtatagttttaaggcattctttttattgctatgtaaatgctaaacgctaaatcggtaaaacactttcttaatcgagtattataatgagggtgttgttttaacatcttgtacgagtcacttctttttaatgtcgcggtgtttactgtgttgtttagtcaatantaacacat

SEQ ID NO: 6635 - DNA, 419 bp, Diabrotica virgifera
  Clone ID: LIB150-035-Q1-E1-F10
cccacgcgtccgcccacgcgtccggttgagaaaaaggctgtacagaagcccgctggggatgcaccaaaaaaggtgcacaaaccaggaaaacctagaaactatgatttgggaaatggagtactcagattctctaggtctaaaatgttccacaaaaaagcattatacaaattcgttggcaagaaagtagaagctaccacgagacctcagaagcgccaggttatttgaaaaccaattggtgggaaaaaaaaattggaggaaagaaaattttttttggtcaaaaaacttagaagcatctaatctaacccaagacaaatttaaggcaagccaagctaggaaaacattaacccaacacacaaggtcaattagaaatacaatcactccaggaacatttctcatccttttagctggttctcacaaag

SEQ ID NO: 6636 - DNA, 340 bp, Diabrotica virgifera
  Clone ID: LIB150-035-Q1-E1-F11
aaagctgatgatgcaggttaattagcattcaccgtccgcgtttacattaacgtagcagatatcagcgagacatcaccggaaattgtatgagatccttaccatttgacagtcagggaatgtctatgtaggacacctgtcgggtttgtgcaagctactgatgcatatgaacgtgtcaccgctcaggtcacctagttcattccctcacatttgcccttcgagatagacaacgacagtggaaagatcacgacgaacacacctttggattatgataaactgagagattatcaacttgtagtaactgcataagatggtgctacagatcccatcattgcaactgcca

SEQ ID NO: 6637 - DNA, 219 bp, Diabrotica virgifera
  Clone ID: LIB150-035-Q1-E1-F3
gtaaaagcaacatgaagattgtaagttatattttatttgtgcttggtcttgttgcattgggagtattccaagcggaagctgcaaaagctccgccaattaaacccattcttaaacacgttcatgtagacattcaccatcatgaccatgactaggaccataattaacacatttttcattaactttgttataacatgaataaaatatattcttacattgaaa

SEQ ID NO: 6638 - DNA, 425 bp, Diabrotica virgifera
  Clone ID: LIB150-035-Q1-E1-F6
gccctagttcatccgtgacatttctttctttgcaattcgggaaggccctaagctgtggtaaatggttaaagcggagagaagaggatatgggtttactgatgaggggaaaaagatctccgaaaccggtatagactcttcctgcactctccgctttaaccagaatattatgcagctgctgcattttcgttttgcaaagaaattgagaatgtttatacatttttaattcatttactcttttgagtattaaggaatctttcttgttggagctttaccatgctgagtagatgagttgtgaattatttaaaattctctcatcttaattttctcggcacctgtatgacttataaattgtaaaagtctcaggaggtgtaaccaaagaaagtattccacctgttgtcaatctggtggtacggaggcgatattta

SEQ ID NO: 6639 - DNA, 356 bp, Diabrotica virgifera
  Clone ID: LIB150-035-Q1-E1-F8
gtgagtcgtattagttttttagtaacagtaaagaaaaattttatttaatgatagttaattagtattgtgagagaatattttagtttgattaactaggatgtttagtttttgtaccttgtgtaacagggattagtaattaataattatatatttattattttcgaatttaaaagagctaagaaattaacatttttagtgtctatctagatattttaaatagtttttttgtaatgaaatgttagtcgtttttagatatatctaatttttgacgaaggaggttcagtttatttagtatcaatatacttaggagtaaatatttttatattattgctattaaatattttgagggatgagct

SEQ ID NO: 6640 - DNA, 393 bp, Diabrotica virgifera
  Clone ID: LIB150-035-Q1-E1-G11
cccacgcgtccgcccacgcgtccgatggatattacatacctaaataacataactaagcaaattttggtatatgttatgcgatattcacattgcatctctcattttaaaaattgattgctcagtcatttgacaaccgattttaaaaacttttatatagctggataggtacatgaccatttttatgccatttttttttcgtatttgaaagcgatataaaaaattcaatacattcagacaaaacttttactaaaataaacaatttcagcgaaaaccgtatatttctatcttgagccgtttagaagttagaagcagttaaaatgggggaaaatataggtggacacccggtataataagtaaattcggtagttcgtcacctcgatttaagtagcgttg

SEQ ID NO: 6641 - DNA, 333 bp, Diabrotica virgifera
  Clone ID: LIB150-035-Q1-E1-G3
cggacgcttgggtcacccacgcatcttttaatacaagtccttgattgtttgatatatggctcgttaaattcaagttgaataccaaattgtttaaaggccactcacattagcccatgttatcatgcgccaatgactgaatatatacacattctggatcatcggacttgactcatcttctgtgggatatggctactgtaaaattactatattaattgaatattatactatggatggttagactgtagccatcacagctgactttatacgaattgtgtcaggattacgtgataacaccatcattatgtgtaacaacttggacgatagtaattacac

SEQ ID NO: 6642 - DNA, 360 bp, Diabrotica virgifera
  Clone ID: LIB150-035-Q1-E1-G4
cgagtatccaaggtagtttgtgaaccctgcgcaacagtgatcaggcgttggtcttcagttccattccacacttcgggaatgaattgcatactgcgattttcgagtaatgtcaactgacccattgccattttcacagcaattctgccaatttgtgcacatgatatttactcgatgcagctatccgctttaatcacatcaaggctgatgaggcaccggcaccgtcgtgtatcccactcaccggacatattacccgcatatggtgcagacaggtataagaacgcgttttccatcggctgcaactgccacactaccaggcttcccatgactacatggagaaatcaaatctgtagcggcagacac

SEQ ID NO: 6643 - DNA, 418 bp, Diabrotica virgifera
  Clone ID: LIB150-035-Q1-E1-G5
gaaccaaatttatagacaacaacttggttcaagatttggttacggttgattgggtcgtctcggacgtgttggccgggtgcatgtagacgaagttcctaacgcagtcgtttcccttcaacttctcgaacacctcttcgccagtcaataattgatcaaccaatcatattgactgatatcaccgaacatttacatccaatcactgacgacattcactaccagcatcatctgattaaccaacagattcatttccttattgatcaattaacttaccatcacaacctcagtacacgtgaatttgaacaatacattgttaaaggacaagttgttcctcaggaacttgtctctcatcagagattgatataccaccatcttcatgatgtaattgaacctctgacctcccaacaaatattcatcaatc

SEQ ID NO: 6644 - DNA, 404 bp, Diabrotica virgifera
  Clone ID: LIB150-035-Q1-E1-H1
ctcaaaataaatttggtcccttgtaggtaagttattggtgataccaaaaatctcaagtacctagtaaaaaaataatattttttaagtaattatattataggttttgctattgtattttggactttttattttcctaaaaacaaaaattggttaagatatggctgttcaaaatttgcatacgctcgtgattagttactagtttaagcccatttaactgcagccttttcaaaaataagcactttaaacccattaatcttacagatgttataaacaataaaatgtaaagtaatttttgaagtggtaatgattaatttaattttggatgctaattgggagtgattttcacgatttttttttaccaacaaaaaaatggaccaacattcttttgatcgtaacttacttac

SEQ ID NO: 6645 - DNA, 383 bp, Diabrotica virgifera
  Clone ID: LIB150-035-Q1-E1-H10
cggacgcgtgggttgaattatgataacgtacagtatgtagcagacaacaacattgatcaaggggccggacagcagcactacaacccacagcagtattattatttgcaacaacagtaccaagcacctactacgtctatacaagctgtggtggacccaaaagggggtttgcagtacataatgtatatcccaacatatgtgtccaaccagggaagtcaacagcagtcaactgaccaaacccagaactacgagaacgtcgtctatagcgacaacgaccagacgtaccaacaaccacaatcatcgccccaatataccacatacacagagaaacaaccactcttgaaactggcaagagcgcatacaatgttaaagctacagacttcact

SEQ ID NO: 6646 - DNA, 84 bp, Diabrotica virgifera
  Clone ID: LIB150-035-Q1-E1-H11
attacaacatcctaaagtgagtcgtattaaactatgagaacgtgcagtacgtaccagacagtgagattgatcaaagggtcggac

SEQ ID NO: 6647 - DNA, 323 bp, Diabrotica virgifera
  Clone ID: LIB150-035-Q1-E1-H12
agttggatttatcaggagctatgtccggaacacttgtcgttaactattcagcatgacaaatgggatagcgcaagatggctcaatgttcactatttccaagcgtcgtgcacgaaatgaaagatgtagcgcatgcattcatgtaccggatggcgcctgatgtgttgccaccaccttagttaatgggcctcgctgcttcgatgcagatgtagagtatacccaagataaaaggtgtctggtcgaattcgtatattttccgagaggtatacaatatgttgtgaataatcaacagttacgtcaggctcgtaatggggacaccgtaggtg

SEQ ID NO: 6648 - DNA, 332 bp, Diabrotica virgifera
  Clone ID: LIB150-035-Q1-E1-H4
ggtcgaggcacgcgtccgatatgtctgttttttatattatattatgttattgtttttttttctgtacactatgtatttttgtagaattgggcttgcccgtaaaataaataaataaataaataaaacaaaaaaaaaaaaaaaaaaaaaaaaaaaaaaaaaagaaaaaaaaacaaaaagataaaaaaaaaaaataaaaaaaaaagcaaaaaaaaaaaacaaaaaaaagggtgaccgaacttaaagtcaaaggccgacgttttacaaaatcaagactggaaaacccctagagtgacccaaataaaaaatcctgcgacagatctttaaaaacgcca

SEQ ID NO: 6649 - DNA, 205 bp, Diabrotica virgifera
  Clone ID: LIB150-035-Q1-E1-H6
agtacaggtatggcgtctgtttatttaatgatacttaagtagtagtgtgagagaatattttatttttataaagggacaatttagtttttgtcccttgtgtatcagggattagtggttaataactagatatgtattaggttcgagtttagacgagctagcagcttaggatttctagtgtgaaggaagtatctgaaatggtttgttt

SEQ ID NO: 6650 - DNA, 410 bp, Diabrotica virgifera
  Clone ID: LIB150-036-Q1-E1-A10
tggcaaaatacaagtggacacccgctattaaaaatggagaatttgatagatctcaaatatgtcaacacgcatgggataatgaacatagagttcagtggagagattcaagtatagtcctgaaagaaacagatagtaaaaagagaataatcaaagaagcggcgttaattatgctaaatgaaacaaactgtgtcgcaaattcctcggtagaatgcagtaggatgtggttaaccatactaaaagaggaagtcaatagaaagaaaataccaagattagtaagtcaataacatatcgagttagtacaatatttaaaatttaagaatggttatataaccaggtattattaataatatttataatttaaaataacatatgtacagtcacaatcactgaatagtttacacgctttaata

SEQ ID NO: 6651 - DNA, 313 bp, Diabrotica virgifera
  Clone ID: LIB150-036-Q1-E1-A2
agatcccaagtactgttccttttattctaattttactttcgaacagttgcatttactttacttccaaacaatcagcatgggtaaggagatgattcaagttaacatcgttgacattggacacgttgattctggtatctctactactactgagaatttagtttacactatgtggtggtagcgagacgcgtgccatcgatcagttctaaagagaattccaacaacgtggcttatggttcattcatatatacctgtgtagtcgacagacgtaaggccgaaagagaatggtgagagtagcattgataatgctttgtgg

SEQ ID NO: 6652 - DNA, 355 bp, Diabrotica virgifera
  Clone ID: LIB150-036-Q1-E1-A6
acgcacggtctcttccttgcagtaccaattggtgctatttagttttgtgttctgaggaaagattgtgaagtgtatgtattcaaagattcggtttaaatatgaaagcctgtgatctattgttgtggttttgcctatttatagctacagcgacttcacaatttataaacagtgagcacattaattctacagtaagaagaagaagagaaaacactagttacaaatgtacgctaccacagttcccacctaatgggagatggatcataattaatggagaaggttatccaggtgacgaaattgaagttaacaccatccttcaaatagaatgtaaggacggctatcgattacacccaaacat

SEQ ID NO: 6653 - DNA, 388 bp, Diabrotica virgifera
  Clone ID: LIB150-036-Q1-E1-A7
gggccgggccacgcgtccacggacgcgtgggtagaaaacaccttgctcaatcagttacgcacccaatatagccaatacagtcaacagagcagctatggtagttcaaactcttaccaacacaatggaggtgcctacgtttaccccgtaacacagagaccagtatactacaccacaacctacaggccgatttacccaaccttgacatctggaggatacgtcgacacccacaatcaacaatataacacggttaagacacgatacactccaattgctaatcctgaaagtctcacatcgattgcttcaagagtccaaagtcaattggacgcaaatctgaacaacgtactggacgaaacacgtagaactcacttctcatcaagtcaacagtact

SEQ ID NO: 6654 - DNA, 363 bp, Diabrotica virgifera
  Clone ID: LIB150-036-Q1-E1-B11
cgtattattccaacagttcttattttaattaaagctaactacgcttttgttaattaaatgttatttaaaacaaaaggaattacctaattccattaaaatagttaacccgtaaatattggtgatttaaaatattgtgatttatgtttataccattgtttaatgttattatttttattagagattatagaattattattattagaaagttagtgaaccatagtttacgttattgtatctctcatagtgttcagcatgactacatttccaactatctttagaatagtattatcatatctatcatacctatcagaagagttttctttatttatgataacgtccttctttgattagttttaatttggc

SEQ ID NO: 6655 - DNA, 465 bp, Diabrotica virgifera
  Clone ID: LIB150-036-Q1-E1-B12
ttcgtcacaacaccctataaagagtcgtagtaacatttctataatttattccaactaaaaaggaaataatttcttttgcaaaacaatgttattgtgaacaagacgatgagtgttgtatattaattcgtacagaacaacgaaattactgtatggtatttataagaaaactgtgtacttattacagtgttttaaaagaagagcttaacaatattttacattaacaacccttacaaatactagtccactcccaataaacaaatcagatcaaacaatggaagaaatccggtttggaattggggaaatggagagcacctcgttcctggaagagtatccggtctggagaggttgacaacccccgctttaaataagggtctggcattcaccttcgaagagagacaacagcttgggatccatgggttgttacctcccgtagtaaaatcacaggaacaacaaatcgaacattgt

SEQ ID NO: 6656 - DNA, 396 bp, Diabrotica virgifera
  Clone ID: LIB150-036-Q1-E1-B5
tacccacgcgtccgcccacgcgtccgcatcaagttggtagatatagccgaagacccatgtacccagctggacatcgcaaactccaacatgttgtagtgcgtagacttaaacaccatcctggacttacatcaggacgtcttgcaggtaaaccagcagtatctcgtccttgtaaacaatcaggtagcccggcaggttcaggacgtcgtccattccgtcgtccagcgtgcaggccaatgatacgaccagcccatctttcaggtcaaggtggtcaacatccagcgcaacaagagcaccaccaagctcaacaacagcagcgtccatctcaacaacagcaccatcaaggtcctcaagctggacaatgcagaccagcgcgcaaaccaagaattgtcaagcgcc

SEQ ID NO: 6657 - DNA, 398 bp, Diabrotica virgifera
  Clone ID: LIB150-036-Q1-E1-B8
tacaaatgttcgttgtacgtttggccggctgcttttaggaattcccaggtagtatgttaatactaaactggtattagtgaaattcgcaatggggacgttatgaaaagaacaccatcaaggtttacctctcgttaaacttgatgtatgtatttgtctaagaaagtgtaaatttgtgcaatttgtgcctcgtttttattttctccgggtttttggtggtacatatacggaaaagttaatgtaaaaaggaagtcaaaatgcatttattgctaatagctggtgatttatcactttttcttggcacagtatattttgtattaagtatattcgtggaaaaatcatataatggtatctctgccaaaacgcagttgctctacatgatagtctgtactacaagatat

SEQ ID NO: 6658 - DNA, 212 bp, Diabrotica virgifera
  unsure (1)..(212): unsure at all n locations
  Clone ID: LIB150-036-Q1-E1-C12
tatagagagtcgtattaaaaanngcgactcactagtnggagtggcactaaccagtacaacgcagtgaagcgactcttaatttggtaatcgcgaaataggtacgtagcccctatgctgtgggggaggttgacgttcagagcagacaaacggggggctcgaccttcatggggatactcaatcgcgatcgtgggatactcccggagatacaaagt

SEQ ID NO: 6659 - DNA, 391 bp, Diabrotica virgifera
  Clone ID: LIB150-036-Q1-E1-C4
aaatccattagaagaaatgccagttataataaaaaaagagaatccctcttccagcgatagaagcaagaaagccatggacgatgtagaaggagccaaatctgctataaaaagatttataggagatgttagcaagagctctgctactaagcaaataatcttgggggcctcctctggatgggtaaccggattcttatctatgagagtaggaaaaactgctgcaatggcattaggtggaggaattattcttcttcaaatagctaatgaaaagggttacattaaagtcaattgggacaaagttaatagaaacctagatcaagttgcagataaagtagaagaacaactaactggagaagcagtatcctgaatggataagggtgaacggtttgttgat

SEQ ID NO: 6660 - DNA, 146 bp, Diabrotica virgifera
  Clone ID: LIB150-036-Q1-E1-C6
gggtcgacacacgcctctacacagactcctgagtcatcggccatcgtagtatttttatttcatcagtaagccataatatccaaaaatggttgataaaattgacatgagtttggacgacataatcaaatcaaaccgaacacaacgag

SEQ ID NO: 6661 - DNA, 371 bp, Diabrotica virgifera
  Clone ID: LIB150-036-Q1-E1-C7
ggcattttctaagcaagctggtttgtttttgtgtatagtcgcgtctatcagtgcgttacccacggcacacgatgaagcgcgcggtaattcagttcaaaccgaacacgatcttttggatgccgtttacaacgactgccttaaaaaagactctatgtcttgtctgaagtataaagtttttaatttcgtggacaagatgatcggcaacagggaaacaattacagtgatggatggtgttcagttcgtcaaaactcccggtggtgaacaggatggtgctccacgcgctattagcagtgacgacactatcgaatctgtcattttcaacaggattacatcgttcttggggtcccatactttgaaaatcgatttgaaag

SEQ ID NO: 6662 - DNA, 295 bp, Diabrotica virgifera
  Clone ID: LIB150-036-Q1-E1-C9
atagagagtcgtataaaagcgtgggatttttttatatgaatctccgtatatcgaaaataactacaatgatggaaacatttttgtattgaatttaaatatagcaataccagatgcagcttgtgaaatgtatttttatatcgagaaaaataagatattaataataaaaaaaaaaaaaaaaaaaaaaaaaaaaaaaacaaaaaaaaaaaaaaaaaaatcaaaaaaaaaaaagaaaaaaaagaaaaaaaaaaaaaaaagagaaaaatgaaaaaaaaaaaggggcggccccccaaagggt

SEQ ID NO: 6663 - DNA, 394 bp, Diabrotica virgifera
  Clone ID: LIB150-036-Q1-E1-D10
acaacacctatagtgagtcgtattacatagaccaatacgtatatattacataagcttaaaaacaagatataatagtatccgtttttaaaaagaaataaataatgttcttaatattttattaaaagttctaatagttattaaggtatcaaagttattatctatcatacccgtggtgccttcaacgtttaatgtccgactaaattattatttacatgccaaaaatttaaatgaatttttaattaaatagttttcaaataagtacatttagttagcaatagtcgtaacgtaattgtggtagcaatagttggaactaaggtgggaattggcaaccttggaattattaagttattatttaaatttaaaaacttaaggcgttatttttcaaaattattgg

SEQ ID NO: 6664 - DNA, 352 bp, Diabrotica virgifera
  Clone ID: LIB150-036-Q1-E1-D11
tcgacacaagactctagaaagagtcttaatagatgtgttagtgatggtaaagggcaatatataaaatatgaatttagttgcgctgaaggaacggtttgggatcaagatgcacttgcttgtaattatccttcagcagtaactggcgaatgttcacaatcctctcagtcacaatctaacggtgaccaacaaggatctagtaataataatcaaaatcaacaaggttctggcaaccaaaaccaacagggaaatggtaatcaaaatcaacaaggttctggaaatcaaaaccaacagggtagccatagccaaaaccaacaaaacaatggacaccaaaatcaacaaagatctggtaaca

SEQ ID NO: 6665 - DNA, 371 bp, Diabrotica virgifera
  Clone ID: LIB150-036-Q1-E1-D2
agaacatttttatttgtgttgtggatgatcgcagtgtgctgtgctcacaaaaataaacatagtaaccgtatccacaggcgtttctctttgtgtcattcagttcgagagagacagagctataattgagtgttaaaattctttagccgcgagtttttatattcacgaaaaaatgggttgtgccactgggattgttaaatatttggtgtttttggccagtctattgtttgctcttgctggattagctttaataatcataggaattttaatcaaattgaatgttagcgaagctaccaacgttctaccaaaagacttcggtctagctccaatcctctcgatcatcatcggttccatcgtcttcatcacagcgtttc

SEQ ID NO: 6666 - DNA, 156 bp, Diabrotica virgifera
  Clone ID: LIB150-036-Q1-E1-D3
tagtgagtcgtataaacgcagcaaggtactatgagtgttgtggatgctagtaacgtgcagtgctcatgatctcagccatattaaacgtatcgataggcgcttcgcatcgtgtcgttcacttcaggaaagaggcaggggttcttgcatgtgataatt

SEQ ID NO: 6667 - DNA, 306 bp, Diabrotica virgifera
  Clone ID: LIB150-036-Q1-E1-D5
tagtgagtcgtatatactggtcgctccactgttcggaattgtcactttgtcggcggaatcttagaatgactgatgcggaatctaggaatgaccgcggaacgcgcgagtggggcataccacgggaagataccttcagggagggcagccgacaccggggtaacgcgagtacaacacgttcgagctgtatggcctccggaactagagtgtttgtatcagggattccctaggattatcgttggcaagatgttagcgacagtcttctggaatgaggtgggtgatgtttcgttcgtggagctattttacgat

SEQ ID NO: 6668 - DNA, 423 bp, Diabrotica virgifera
  Clone ID: LIB150-036-Q1-E1-D6
tacggacgcttgggaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttt

SEQ ID NO: 6669 - DNA, 361 bp, Diabrotica virgifera
  Clone ID: LIB150-036-Q1-E1-D7
gtttactttaagcgggccttaatcttaagctagccttaatattatagtcggtgcaaacggcccataaagttcagttttatcggttaacatcaaatgtatcaaatcttctttttaaaaatccctcagatcttatcgaatcaagtcaaacgcatcctatatatgtagagtatagagtgttatattaggcaggtggcagtttttgccacttggccaagttttcgcaagctgtcaattttcggcactttgtggcataatagtacaattttttatgtaaaacactagttttggcaagcaactcatacagataaacatacagggcgtagatttatacactctcagtttagatttgttttacaagaaa

SEQ ID NO: 6670 - DNA, 386 bp, Diabrotica virgifera
  Clone ID: LIB150-036-Q1-E1-D8
cttctactgtggaaccagttcattttctaatattacgcagtcatgttagtttctttccaccaatccatccctttctctccacttttccttgtactataaggcgaagtagatgatatttagatcccctaattatatggccgaaatatttggcatctgcctttgacatctgttcttttcgaattcctctgtggccctggattttacctttttacctttcgtgataagctaggattctgtaggtaatggtctcctctaataacataccctatgtgtgaagtaaataccaattgaggtaataaataaataaaaatagaatcaatcaatttttcgaagagaaagttcagcctctcacgactctcaccacaaatggactgaaaaaatgaaca

SEQ ID NO: 6671 - DNA, 395 bp, Diabrotica virgifera
  unsure (1)..(395): unsure at all n locations
  Clone ID: LIB150-036-Q1-E1-D9
aactccctatagagagtcgtattaatacagcttatacagcaataccaggaattcgaaacataggacgtgagaagattcattataaacagcattgattgattctcaaaaattaatctcaacaacagaaatatctttagaacagtaagggaaagatgatgatgcagaagtaaaagacttttagattggtgtttataaagctcattatataactacaagtaatatggtttgaacaggtaagctatgaggtcaccaaatgcatccaatgcagaattgaatgaaggaaaggtttanaaaaaggttgtaaaaggattcaagccagtgttgttgttgattgatgttaaaccatataatatttatactgaaaatttggatccaagtgttgtaaagggtttttt

SEQ ID NO: 6672 - DNA, 174 bp, Diabrotica virgifera
  unsure (1)..(174): unsure at all n locations
  Clone ID: LIB150-036-Q1-E1-E1
tagtgagtcgtattaaaaantgcgagtcgcaaccaggtatctgtcagcatggtgtcacccgtccttttgagacagcagcatcagatcacgtggttcttgttggagagtcatacctactcacagttttttatgacagtggccgagctgacctcattataggtgaatcgtaagggt

SEQ ID NO: 6673 - DNA, 396 bp, Diabrotica virgifera
  unsure (1)..(396): unsure at all n locations
  Clone ID: LIB150-036-Q1-E1-E2
agcccacgcgtccggttaggctgtgcaaccaggcattagttacttaaagatcgccaaatagcgatagcatcgctagttgtgagtttttatcgttgctatcaagcatgtcctctcttttgtttaatggttgttgttatcgttaacttaggtggatattttaaggggaacgtagctgtttcctggatttatcagatgctcattaggttttagtgtattatgtatttaacagagtgaaaggcagcttttgatatatgtgttggatgtatacgataatgttttgattgcagtctagattctagttcagcgattttagtttaacacagagacttgtggagacgatgtgaatatttgccaacaacattaanaggangagatataatttttcctctaagtact

SEQ ID NO: 6674 - DNA, 409 bp, Diabrotica virgifera
  Clone ID: LIB150-036-Q1-E1-E6
aacccacgcgtccgttcacccctaaaatgcaaaaagcgcaagttggcactatgtcacctttgttccttgaggtatcctttaaccactcaccaatttttatgaaaatcgatggaggttcaacgaaatctgaggtaataactcatatccaccttcattgactccactatatggttttttcaaaaaactaaaccaaagccttacattctaaactcgataaaatttgtttaccgtttaaaaccttctacgaattatttacaaaaatcctattgatgttcacaaagcgaaataacatgcactttccaatattttcgaaccattgtctgtaaatcctttcaaaaaaacccattaacgatttcaccttccccgaaaaggcactgtttattaactaaattagactctatacaatttt

SEQ ID NO: 6675 - DNA, 133 bp, Diabrotica virgifera
  unsure (1)..(133): unsure at all n locations
  Clone ID: LIB150-036-Q1-E1-E7
tagtgagtcgtattaaangggacgcacaccgaatgggagttcagtcgggggtggagcgtagcgtgttcgggcaggaggagttgtgagtgctgtcagaactgttagccggcggaccattcttctgcggctacga

SEQ ID NO: 6676 - DNA, 257 bp, Diabrotica virgifera
  Clone ID: LIB150-036-Q1-E1-E8
ggaaagcgttgccgacaaactgcgaccataacactgcgatgaatgacgtcataaaaaactgtaccatgcaaactaatagcggtggtttccaaggatgcgttggaagccaccgcttgctgattttgcacattccattgccgcagtgaagaaccttgaatttttcaccgtaatctgaccagcgcttaagcgattgtttcagtcctggacattttcgctttccgggtgaaacaatttatatatatatctgattggtaaaa

SEQ ID NO: 6677 - DNA, 350 bp, Diabrotica virgifera
  Clone ID: LIB150-036-Q1-E1-F11
caacactctatagagagtcgtatgatagattctgtaggtcattctgttattaagccgtgtcagcacgcatcgcaataaaaaggtcgccgatgaatcactggaccaggtaatcaagaaatttcaagatctcgaaatttcttgagtcaagacaagatataacatgtcaagaaaacgtcaagacaagattttttaaatttcttgattttttctcaagacaagacaagaagttgttatcaagacaagaattcttgtcttgtcgacccctacacttaatgtcctatttttcaaggcacttgaaatattcatatttacaaaaaatatatatattgaatgtattccaaataaacaac

SEQ ID NO: 6678 - DNA, 414 bp, Diabrotica virgifera
  unsure (1)..(414): unsure at all n locations
  Clone ID: LIB150-036-Q1-E1-F9
tctcaagataatgtaacatcgaccacaagagagcagaaacgcgcatttatattagttgttgtttagttgtttagtgaagtgttttattagagataatgacggacactactagctgtaaaaatcattatttatttagtgttatttatgctgtgctgtatataattgtgtttatatacgatattttgacattccctatatatttgctgttccaaaatcctatcaagagagtacaattagccaaaattgaaagggcgacaattgtagaaaaaggtgacaaatacatcacttacaagacgacaaagaagccttatcctacccactatganatcgacactgaacacatcgacactatggcaaaactgttggagcatgctgccaaaaacataccgataaacgtttgcttggaactagaga

SEQ ID NO: 6679 - DNA, 287 bp, Diabrotica virgifera
  Clone ID: LIB150-036-Q1-E1-G10
aagcctctataatgagtcgtattaaaaaaaaaaaaaaaaaaaaaaaaaaaaaaaaaaaaaaaaaaaaaaaaaaaaaaagggggcggcccaacaggatgatagttgcttaattcctcatggatgcgacatcatacttctacaatatagccaactttaattacatcgccggccgttttttaacatcgtcatggggaaaacccccctgttgtcaaccttaaaagtcttgtagaagaacacccttttttcaccagctgtaatagtaatgaggcggcccccattgttccccc

SEQ ID NO: 6680 - DNA, 456 bp, Diabrotica virgifera
  unsure (1)..(456): unsure at all n locations
  Clone ID: LIB150-036-Q1-E1-G11
gcggttcgacacaagactctagacagagtcatgtgaccgattttacatcaaattactttctataattaattactcctgttattaatataccaccagaaaacatatagaggcaagaaaatgcatccagaagaagtaagcagcgtttggttaaacaggagatactatgaggatgccgaaatcgctcattatgaaaacttaacaaaagcagctttaaccccattggctggtgaagtagcaaaagctccgtcaaaggttaatcgaaagtagggacacttttacatcanacgttgattccaaaagacactggagccataaaaattaaggagaaaaaaatagttgaatattaaaaaaacattacatctcttgttacacaattgaaagccttggaactaagagtagctgcttttggaaaaacagacagtcagaccaaacctggtacacaaatcaacatacagt

SEQ ID NO: 6681 - DNA, 366 bp, Diabrotica virgifera
  Clone ID: LIB150-036-Q1-E1-G2
acacagacgtcccgttaatgcgtcagctgacgcttggggtgacgcatggttttatttattgatagttaatacgtaatgtgagagaatagtgtcaggtttagaaaggacgtctttattatttgtaccatgagtatcagggactatgaactaatacttatatggttatgactttcgtaataaggcgagcgttgaaaattcaaatttttactgacatgtacgtcattgagataactattatgcatggagatgttactcatttttaagtacccctaagttttgaagcactcaattaagcatacccactaacactatacatataattaagtatgtttacatgatcaccattacctgatcttagagatgagc

SEQ ID NO: 6682 - DNA, 382 bp, Diabrotica virgifera
  Clone ID: LIB150-036-Q1-E1-G4
aaccaactgaaactgtaaaacttgaacataagaaagacgctggagtagctctgttaaatatattgaacagacattacacagacgctgctattatcaccgccaagggtggaagagtagttcgagacattgaaagaaaaatcatacaacttgtgtctgatgaaaaatcaataatgatggtgaatgatttccatctggcacctgcatcatctgtagttgtcatgcatcaagttggtagatataaccgaagacccgtgtacccagctggacatcgcaaactccaacatgttgtagttcgtagacttaaacaccatcctggacttacatcaggacgttttgcacgtaaaccagcagtatcccgtcctcgtaaacaatcaggtagccc

SEQ ID NO: 6683 - DNA, 265 bp, Diabrotica virgifera
  Clone ID: LIB150-036-Q1-E1-G5
tagtgagtcgtattataatgttagttgaatgtttgttacgtgaattccaggaattttttctttaacgatagttactgagaaatgctgagatagtatttcagcttttagaaagggacaaatttgactttttgtacctctgggtctcacggattattaggtggtagttagacatttattattttcgagtttgaaagagctacaagatttacagttttattgtcatgtttctatattagatagcttttttgtgatgatacgttagtcg

SEQ ID NO: 6684 - DNA, 392 bp, Diabrotica virgifera
  Clone ID: LIB150-036-Q1-E1-G7
cgacccaagaccctatactgagtcgtgttaatgatcgtgatgagtttgcgatgagttctctgtaaaaaatatattttcaacgaaccgtacgccaacagttcggctcgcataagtgtaccgaccttgggacgtataggatattcgcatttcaatttggacagtgctcccagcgatattgtctgttcgtttcgtctcatcgatattgtgtgacgtgttcctagtttgaatatagtgtatgtttttcgtgaacccaagttttccatgatggcacagtggcccgacgataaatgtattgaacttattgacttatatcacaacaagaggatactctgggatccgaaagaccgtgatcatttccaaaaaagcttaaaagatgacgcatggcgccagat

SEQ ID NO: 6685 - DNA, 282 bp, Diabrotica virgifera
  Clone ID: LIB150-036-Q1-E1-H1
tagtgagtcgtattaaatgcgctgtctctcttgtagtcatcttttgtgccgctgggtgtcattgtggtgcttgaagatcacgcattatgtagattatctcagcctcgtcgcgaggggccgagagagttcgatggtggagttgtcagtttctacgatgttcacatttcaggattgttattgcacgtggtcggtgtctacacgtactcgtgaggtggataaatgtgatgagtgtcctgcgtgttatcacgaggttgtatatggtctagctatgtaggcataaaa

SEQ ID NO: 6686 - DNA, 85 bp, Diabrotica virgifera
  unsure (1)..(85): unsure at all n locations
  Clone ID: LIB150-036-Q1-E1-H11
tatagagagtcgtattaaaaantacgactcactacacggagtagtactaacttgaacgactcactattgggtctcgttttaagtt

SEQ ID NO: 6687 - DNA, 354 bp, Diabrotica virgifera
  unsure (1)..(354): unsure at all n locations
  Clone ID: LIB150-036-Q1-E1-H12
gtcaagaatcacggaaaagctgatctttttgttgaggtaatacatctcaataaccaagatgatgctccacaatggtttgtagtccagccagaccaaaccactgagatagatattgaggataatcttgaacaaagcgtgttgaaagtaagcaacaacagttacgaacaggaagtatcattttctgctaaaggtggtcacgttattgacgacttggaaaacaacatggaagaacttcttgactcaaacgaaacagaaactgaaatggtcgttctggaaaacttttctttaagcccaagaactgctgtcactgttttgagtcanaatgttgaaggaagcaatgaacatcctggaaag

SEQ ID NO: 6688 - DNA, 389 bp, Diabrotica virgifera
  Clone ID: LIB150-036-Q1-E1-H2
gcccgggtcgatacaagactctatagtgagtcgcattatttaccacacaaagcacgtaaacaataaatgaaaaattccctatgacaatttcagctatacacgaaattgtttggagtcaatatacaacattaaacatgcattaaacattacaagcattaactccttaagctccttccatttttgtgacgtcagacttgggctgtctggagtgaaaacgcgtttttaaacgtatttgaacgtcattaagcttacgtatttaaaatcacctacaaaagacgtttatatgacgtaatgttcaaacacgtgtatatattcaaccaaaaactgacgtttgctcgacgttattgacgtcacttggttgcctgagtaggctcttactatatagttga

SEQ ID NO: 6689 - DNA, 304 bp, Diabrotica virgifera
  Clone ID: LIB150-036-Q1-E1-H4
tacctttttagcacatatggtacccatcattcttacactgtggtgtgattgtgctgcttgattaagacgcacttttaatattttcctaccctcctcgcgaggggctgaaaccgttctttggtagaattttttaatacttcgatgttcacatgtcatgaatgttttttcaagttttcggtttcgataagtgtccatgatgtatatatacgttagtattgtatcgtgtatgatcacgatttggtatattgtttgaataagtctcgttttaaatccaggcatccgaatatgaactcttctattgcac

SEQ ID NO: 6690 - DNA, 304 bp, Diabrotica virgifera; identical to SEQ ID NO: 6689
  Clone ID: LIB150-036-Q1-E1-H6

SEQ ID NO: 6691 - DNA, 379 bp, Diabrotica virgifera
  Clone ID: LIB150-036-Q1-E1-H7
gcgtcagcaatgaaatacttttacttgacatacgtcttgatcacttacttctactatataaatgccgaagagtctccaagtctagcagctcttgcaccaaaatgtgaatgcggggacatcattgacaagattctgtgccaattgacagaaaactctaaagaaattctcacactccaggtaaaactagtgtcaattagaaaagaatcaacagaacttcaaaacaacgtagctgagaacacgtgtctggttaactcgatcgaagcagacgtcacagtcattgaacaacaacagaaccaaactgtgaccgttgtcaataaccatacagctatcatcgtcgacattgagacaaacctagaagtcatcatccaggaacaaaatg

SEQ ID NO: 6692 - DNA, 352 bp, Diabrotica virgifera
  Clone ID: LIB150-036-Q1-E1-H8
ataaaactaaacctttttagcacaaatggtgtaaaacatagtttcactgtctataacgtttaaatgagtgatacttccaatcgaacttctgagaagacttgatttttcccttgcgacttaaagcattttcacaggaataataaaatgatttttttacacagtatagtcaataacttgcaatcacagtgagttgaataatcggcgattgatttaagactaaccattcatataatacaatagtctatcctacccttaaaacagtgttgccaactcgatgaatatagtaattgccaaacctcacatgaatgatggaatgatcagttcaacagtaggtattccactaacagctaat

SEQ ID NO: 6693 - DNA, 406 bp, Diabrotica virgifera
  Clone ID: LIB150-036-Q1-E1-H9
cggacgcgtgggttcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatatacgtttaatacaggaattcggcaacatttttttcaccttgttattaaaaacatgttcttttgtattaaatat

SEQ ID NO: 6694 - DNA, 227 bp, Diabrotica virgifera
  Clone ID: LIB150-037-Q1-E1-A1
aaccaagccttcaagaggccgtcaacttacctttcaagccaatctgcaaaatcaaggacagaatgggaatggtcaccaaaatgggaacggacaacagaacggaaatggccacactaatggtaatggacaacaaaatggtaatggacatcataatggacgccgttaacaaaatagtactgacagttcgtttgtgaatttgttaattttgtatatgacaaaggcataat

SEQ ID NO: 6695 - DNA, 71 bp, Diabrotica virgifera
  Clone ID: LIB150-037-Q1-E1-A10
aaaaaaaaaaaaaaaaaaaaaaaaaaaaaaaaaaaaaaaaaaaaaaaaaaaaaaaaaaaaaaaaaaaaaaa

SEQ ID NO: 6696 - DNA, 300 bp, Diabrotica virgifera
  Clone ID: LIB150-037-Q1-E1-A3
gtgaatcgtgttactcgtcagcacaacatcgctgttcagtcacaactgcggtttaatagtgatatacgaatgagtttttcttctagtttggtcagctttatcggtgaccatgttgacgagctcatgtcttctactcacagatcggtgaatcatataatagggatggtacatctctgagtttatcattggtgcatacattgctagtatactaagattgtgctaacttaaagtcaccttctagatctaccatgtgataatatgagacactattttttaacaaactgcaactttagcatctac

SEQ ID NO: 6697 - DNA, 409 bp, Diabrotica virgifera
  unsure (1)..(409): unsure at all n locations
  Clone ID: LIB150-037-Q1-E1-A6
cccacgcgtccgcggacgcgtgggcaagttgtctacgaaagaatccagtctcctcataacgttggaacactatttgaaccgttgcgcttatcatatatagttgtctagcaacacctcgctggctaaatctattttctattaatgcaataacttggacgactttctctggtatagtatccattattgttataaacatcaaataaacacctttctatgtttatcggttgctacgcgcatacatgattaagcaatcaatgacaaatttatactcctagtaaagcgtaataaattgtcttttaaacagtatatcccttttttgatgcaagtaatcagttttagaaatatatgtagttcaagtcaaaggtttanagtggggcgatttctatgcacgcaagtttagtacatttac

SEQ ID NO: 6698 - DNA, 218 bp, Diabrotica virgifera
  Clone ID: LIB150-037-Q1-E1-B12
atcttctgcaccagtgagtgtagtagcaaactacagtgtgtacgtacgtattgaattaacttacggcaaatttatcacatgaatctaacgatcatagcaccaccaacacgagttccgtagcggtctacgaaggtttggcctgcttcacaggtttagacgctggccagctgacctgtgcaccacatgtgctaggcatcgcaacagattgtctcaacatg

SEQ ID NO: 6699 - DNA, 413 bp, Diabrotica virgifera
  Clone ID: LIB150-037-Q1-E1-B2
acccacgcatccgggcgaagcgggtgtgctaacgtggtgtacaattttcaattgtatttcctacactttctcaagttagttcttttgcagttgcttactgcataatttcaagtaatttattgtgtttgtgcttataaagttcaaataaacatggcaaatagaagaatgggtggcggacctggcggtggccttcggggcaatcgttcttttaatcaaccaccatttcaaggaggtagtggtgttagcccctggcaggggtctaatagttccggtcagggattgatctcccaaattacttccaatccccaacaacttgctcttgctctcacgagcttactacaacctcaacaacagaatccaccatcgttgctttctttgaatacatctcctggttataatcgggacagagattt

SEQ ID NO: 6700 - DNA, 410 bp, Diabrotica virgifera
  Clone ID: LIB150-037-Q1-E1-B4
gggtcgacggacgcgtccacccacgagtccgtttatacacggtaagtaaagcagacccccctcaataacgagaactgaaatggcatactaattacctcgttataagctgatctcgttatatcagacaacaataatattgagcatacatatgaatatgtagttttctaaaacactaacttcctatagtgaagccattccgagcaatataagatattaaatattgtttgaatggcgctgttgaaaaatatttggtggataaacaggatgatgttgactcaataagcatacagattttaggcatttctgtatacaggcaacttgggtatttatttatagccatcacagcgccaaaaacaggtgaagaaacatgctcttcaacctcattttccctcgttataagtaaggatgct

SEQ ID NO: 6701 - DNA, 439 bp, Diabrotica virgifera
  Clone ID: LIB150-037-Q1-E1-B9
ctaaacccaacaaacaccgccttcaacatgaaacgatcccagcaagttaccgtcactgaaaccaccccaggatattcagtggaaaagatgtattataaagaatacaaatatgaaaccgttttctccacttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacg

SEQ ID NO: 6702 - DNA, 462 bp, Diabrotica virgifera
  Clone ID: LIB150-037-Q1-E1-C1
gccgtgtaggagtcaagggtcgacgacgcgtcagcttggttctgggttaagggtttggataaaccttttaagaactcgggggtaaggggaagtgataaaaaacgtcgttctcgaagccgagataaagacaagcgtaaacgttcccgatctagaagcaaagaacgttccgatagagagaaaattcgcgattctgatagacacaaaagacatcgctctcgttcaagagaaaaagattaccccagtagtagcaaacatgataaattcgacaaggaaaaatataaaagcgatagagataaatacgacgacaaggacaagaaatataaagatgccaaaaaagaggaggaagaagaactggagaaggttaaggtagaaaccaaaactgaagttaaacaagaaccagcgaagaaggaacctctttcgttggaggaactgctaacaaaaaagaaagcggaagaagcagct

SEQ ID NO: 6703 - DNA, 334 bp, Diabrotica virgifera
  Clone ID: LIB150-037-Q1-E1-C3
aaaacaaggaactgactttacaactcatgaagttgagaacgctattaagcgctggttaaaacatgctcctaaccgtaacaagaaaaattactaatttggaattgttttaattttagttttttatttgattaaacatgcaaaggttttataaagaaactgtaggtgaacgccaaatgtgtacgacggtggctaaggaacttaagaatactattgaaggtcttaatagtaatttaaatcaggcttcttcccttgttagtataacagtaatacctagtgataccgtttagtaagtttttaaggataattatataatttgtgagatattgatatgtag

SEQ ID NO: 6704 - DNA, 384 bp, Diabrotica virgifera
  Clone ID: LIB150-037-Q1-E1-C4
acccacgagtccgcacgatcatcatgaatgccttgaatgtccttagcgtttgcttttgcttaactctacctgccgaatccgagaaaaaggaattaacgcaggagagtaaaatgcaagataaacgcggtctttacggccttggtgatcatggtggatgattcggcctaagcggccacgattttggaggcggccatgattttggaggcggtgattacggaggtcatcaataataccacgaacacttcgaaactgtcgtacttgaaaagaaaattccaactccttactacatagtctagcaaatgccgtataccgtatataagaaagtaccatacgaggtcaaggtaccagtactacaaccttacgacgtgtacacaaaagtaccat

SEQ ID NO: 6705 - DNA, 394 bp, Diabrotica virgifera
  Clone ID: LIB150-037-Q1-E1-C6
gcgaactctcacggtgtgtattctttcgttattggcgatttttgtgtctggtacaggcctcaaagaagaattcacttggcacaggatcacttacgcttggcccagaggtcaaggcaatggacctcgtaacagggtgcaaaggtacgctcagtacgctggggctgggggtagtagcagtcctataatctacgaggatcccaatttgcccaacagcggatggaatccttcagaaggaatcgattataatcatgttacgaacattcctatgggtgcaaacgtatggaggaacaagctcttcatcacggttcctagaagacgactaggagtgccatctacattgaactatgtgccattggacagtccaagaagacacaacgttccgctgaatccctac

SEQ ID NO: 6706 - DNA, 431 bp, Diabrotica virgifera
  unsure (1)..(431): unsure at all n locations
  Clone ID: LIB150-037-Q1-E1-C8
taaaaataaaagtgaaagaacttacgtgaaagttaaaaaagaaactactctgcgttcacttctttctattattcaatatctcaccgacaagtgttttagaacaagtactcctcctagggctgaaaccgttgtttcaccaaggaaacgttttcttcgtgaaatggaaaaagataaagttcccggcgatgacaattctcaaaagagaagtcgcagtaaatcgcaagcgaatcaatcgatttccggtgttccacatgcatcgctttctgctccactaattggtagtccagttgtttcaaatggcgtggaggagaccaaacctctccgaaattcaagttacagcattacgtcattactggcagaagatcggaacgtanagagatcacctacgtcatctcctagtcactatccactagcccatccacaatattgtt

SEQ ID NO: 6707 - DNA, 390 bp, Diabrotica virgifera
  Clone ID: LIB150-037-Q1-E1-D1
tccacgattccgattgttcatggttacaagaacagcttgcaatataactggtacaaggtgatatcccccataatcatttcaaatacaacgcatatattttttactccccgtttcttatgacactagacaacaggaatttacaagtaatcataaatgatatgttaatatcaaggtttgacaattttttcacattgaatgtgtcgagtatttggaatgtacaatatggtataactatttcaacactacgattccattttagttacatttctccatgataaatcataagatccatacatgaataatttcttcgctagattccaaagctatattggtcaatgcaatacctaaaatattacgcattttctaatgctacaacgatagcttgcaata

SEQ ID NO: 6708 - DNA, 289 bp, Diabrotica virgifera
  Clone ID: LIB150-037-Q1-E1-D10
caatcctctacattgattcgtattatgatgcatgcaacatcttaatatgatcaacttcagccaatacctcgttgagcaatgtagtccagttgatcatcaattgtacactgtttgttgtgttcctgactagcatgaccattgacgtattcaagatgcagttccacaatccactcaactaatcgattctctcaagtaatgattgaaagttgttaagaaggtccacttaaacaatctttaatcaaatgcgggctataccaattaacgtgtgtgctcaagacattttaaatca

SEQ ID NO: 6709 - DNA, 398 bp, Diabrotica virgifera
  Clone ID: LIB150-037-Q1-E1-D11
cccacgcgtccgcactgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatga

SEQ ID NO: 6710 - DNA, 433 bp, Diabrotica virgifera
  Clone ID: LIB150-037-Q1-E1-D2
agctataatgaattgtaaaattgttttaatctggtttgcgtgttatatttgcagtgtaaatctacaaaaaccgagtgagagtgcctttgtttctcctattttgcaaaccaatcgaagaggtccaaattggattactcataagggaaaaacatattatatcaataatgtgtttaggacaaacttctatcgcgcattacaattttgtagacaacaaggaatgcatcttttaagtttaaaaaatcaagaagagagtgatctgatcaaaaatcatattgaagcaaacgctggatttacacacatgggctattttacatccggagtaaacctagtaggtgatgaccaatggatctggctatctacaggtctggatgtaacatatactaactggtatccaggtgaaacaagcggaaaaagtggatccaatgtacagaaa

SEQ ID NO: 6711 - DNA, 413 bp, Diabrotica virgifera
  Clone ID: LIB150-037-Q1-E1-D3
cccacgcgtccgggaaaaagtgtttagcaacccacctcgtaagctagattttacaatatttatttatctacaagcgatcaataaaatatgaatagttatgctatatatacatacttttgttctttatattattttcatgatctttgtacttatatccaagatattgttcagtctcactccggatgtggatgcaagaagtttagaccatttaaacgattcttaaatgcacataccaaatcaacttactatatcatgtttaggtttcatcatgttcatcatcatcaataacagctgtccattaatttctgttcgtttcttttgcatccgttcggggccaatcaatcgcttgatgtcatcagttcatctgatttcaggtctgtctctacttcttttatttgctcttactcgccatt

SEQ ID NO: 6712 - DNA, 422 bp, Diabrotica virgifera
  Clone ID: LIB150-037-Q1-E1-D5
ggctttcaaatttttggcatttgccgcttttgtctcagtcgctcgtgcaggagtcattggagaagcttactcctcaccactcgcctacgctgcaccagcagtagctaaagtagcctactcaccagccccagcagtctcatactccagtatctcagcacccgtagcatacgccgcagcaccagctattgccaagatagctgctccagctgtatcatatgccgctccagctgtatcatacggcgctccagctctttcatacgccgcaccagtcgctaaagtagcctactcatcagccccagcagtctcatactccagtgtatctgcaccagtagcctacgccgctgccccagccatcgccaaagtagctgctccagtatcatacgccgctccagctctctcatatgccgcaccagtcgctaaag

SEQ ID NO: 6713 - DNA, 74 bp, Diabrotica virgifera
  Clone ID: LIB150-037-Q1-E1-D6
aaggcattcatctgtttggcatttgcggcctttgtctcagtcgctcgtgcatgagtcattggagaagcttactc

SEQ ID NO: 6714 - DNA, 418 bp, Diabrotica virgifera
  Clone ID: LIB150-037-Q1-E1-D7
ctgctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttg

SEQ ID NO: 6715 - DNA, 447 bp, Diabrotica virgifera
  Clone ID: LIB150-037-Q1-E1-D9
aattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaac

SEQ ID NO: 6716 - DNA, 419 bp, Diabrotica virgifera
  unsure (1)..(419): unsure at all n locations
  Clone ID: LIB150-037-Q1-E1-E10
actttagctactgactaactagctcctatttaacaatggtgtcgtgcaaacttattgctgttttcgtttcattgatagcagcggttttagcgtcaccagtgccaggaggttggggctcccatcacaaacatgtcattatcaaagttccgtaccatgttcataccgtccaccatcaccatgttgagaaggtgcacgttccggttcacgttcctgttcatgttcctgttgtgaagaagatcgtcgtccacgaacccatccaccatcacgagcccatcatcgaacacggaggatggtggtagatgcaccagcatcatttaggcaatttatccagatatgtatgttcatgtaaataatagttataatttttgggatactanaagacanaaaaaaactaaagaagtacctataagatattgtaa

SEQ ID NO: 6717 - DNA, 384 bp, Diabrotica virgifera
  Clone ID: LIB150-037-Q1-E1-E2
gacgaccatgggtccaatggccttaaatttttaaaccgtaaaaataaattaaaattggtggaaatataaacatttagattttaataaaaattagaaaaagcaatttggaaagttaaaaccaataacataaattcaccaaaagataaaatcaattcagttcaaaattacttacgatggactgcaaaatcagtcctgaatgcttctgatagtattacctgccctttaaacagaaaacatataatgccaattgaaaaaattgaggaacatgtcaaaaaatgtagccttatatctgctggttacaaaactaatgaagacttcttgtcagaaactccagaaccttcctcgtctttaatttcattagatctatctaaaaaaatggaaata

SEQ ID NO: 6718 - DNA, 400 bp, Diabrotica virgifera
  Clone ID: LIB150-037-Q1-E1-E3
agaaagaacccgtgaaccagaaaatatttcgacattgataagcaagtcttcgtgcgagatcattttttgattttttaattatgtttattagtgcctctgaggcttttagttttgattcaagtactgaaagtagtggtaatagtgacgaagcaatgcctgctataatgagtagtacatcgaattcgttgttaagtagtaaacgttccgccagtagcgcgtccgaggccgattgctacaacatgtctctgggagccgggcctctgtggtggtcctgatgcccctggggaaaccaggggcaattcgccgcccccgctgcggctgactttccgcaccgcccgccatccctgggaagcagtacttaagggacgcacgctctacgtcgcccttcccccgcaagtac

SEQ ID NO: 6719 - DNA, 418 bp, Diabrotica virgifera
  Clone ID: LIB150-037-Q1-E1-E5
actaacagtgaaatacagactgaagggaatgagcaagatcaagcaaattgattggggattgcctaagcatcatcggaaatctcctatggcagcctggacttggctttcaatctcctttgatcccaaggacggcattatccgattagatttggactgcgatcccagcagatttgaaacaataaagcagaaaaagcatttgggtaacttcagtgttccttttgactcacttgtttattttggacaagaaccaggacgaaagaaaaagtttttgggatctatccaggttgcaaaagtcctgccgtacattttggaacagaggctatggtcctgcgtgcagatagccacaaatctttctccagagtttagaaaaccagtatcctaaataattggccattgtcaacaatattaaattcacaat

SEQ ID NO: 6720 - DNA, 316 bp, Diabrotica virgifera
  Clone ID: LIB150-037-Q1-E1-E6
tagtttgactcaaaatacgacaatggggagaagacaatcttcgaccatcttggcaagaaatatcaagcctacgctcagtatctaagacgtattgggcccagtgggactcatttatcttggatgacagcttgctcattctagtaatagaaaatgatgatggttcaatgaggataacacagttggtgattccaaagaccataatagccgatgtacttcgtcagttacacgatagtccatcaagaaggcattttggtgtaaagaaaacccttcaaagaattcgggaacgattttactggtctgacatttccgacgatgt

SEQ ID NO: 6721 - DNA, 281 bp, Diabrotica virgifera
  Clone ID: LIB150-037-Q1-E1-E7
caagcgtccaccatgagtcaaatacttactcgatggattgaacaagatcatccaagctaaatgaggttttgcttttttacgtacgtttactactaccgctgacgcctctaggtttgagtctgtattgatcgtagtgacactattgacgattcagagctcggcagcgatcactactagatctgaattcgttgttcagtattagcatttccgctagtagagcgtcccatggggattgctagagcatgtcgctgggagcctagcatcagtggtggtccttatgc

SEQ ID NO: 6722 - DNA, 433 bp, Diabrotica virgifera
  Clone ID: LIB150-037-Q1-E1-E8
aggaactaaataacacattaacaaaatgaagtatttatttgttcttgcttgtgttgttgttgcggctgtggctagccacctgcccaacttacccgaaaacgaaagacttaaactagctcaagttcacagagactgccaagccgacccaaaaacttacgtcgacgaagacaaacttaggaagcttccaaacttcgttgaagacaaacaagtgggcattcatatgcgatgcatggcagtaaaggcaggattaatgaagcaaaatggagacctcgacattcctagcattacccaaaaatttggtttggtgatcaaagatcattctaaggttaacggattcgtccaacagtgtgctaagaaagcagatacaccagaaaaaacagctattcttcttaccttgtgctgtgtcaaaaacgacattcagtattaccataaa

SEQ ID NO: 6723 - DNA, 403 bp, Diabrotica virgifera
  Clone ID: LIB150-037-Q1-E1-F12
atcaattagaggacacatgtaattttgagccgattttatttttaggtattatcgagcataaagtattcaaattaattaataacaatgccctccgacgctaagaaacgtgaacaacaacgtaaaaaagatgcagcaaaagccagacaagcaggaaaaaagaatgaaaaacaaaaagaagagcaaaatgacactcttaaaacaaatggtctcagtaatggtgcaacaaatggctcgagtgaattaagtgctgaagaagccttatgtgcaaaacttgaagctgatgcccgtttgaatgcagaggctcgtgcatgtaccggttctttagcagtgcatccaaaatctagagatgtgaaaatagatactttttccattactttccatggttgtgaaatgttacaagatg

SEQ ID NO: 6724 - DNA, 211 bp, Diabrotica virgifera
  Clone ID: LIB150-037-Q1-E1-F2
cagaatatcacaactttataggcaaatcaaatggttcccgaggtgaagaaaggaattcttgcacatgacgatgattctcgggcagccttagctactgctggcttggctgaacagaattcgcatgatcctgaagtgcgtcttaaagacagcttggtgtactgtctgggtcattccagggaataattgtgatgtaaagatttatttccggtta

SEQ ID NO: 6725 - DNA, 434 bp, Diabrotica virgifera
  unsure (1)..(434): unsure at all n locations
  Clone ID: LIB150-037-Q1-E1-F4
atgngtgaaagaaaaatgattttctacttaacgttgacgactttgttaattttcacagcactatgtgctggggaattttcagtgctgcatcatgctccaagtcttacctttagggggccatgatgcccttaaaagaaagcactttaaaggatgtttacgctgcagcccttggnttttccactgaacacttctcaaactggaagggcatgttcctgtcagacccttttggagtggcccaggctatagtaactgtgtatgtggatggggtatctgatatagaccaacaaaagggccaccactttcctcttaagactgacatangcgaatctaaggtctacagaagtattganagaagaatcgangaacattatcctaatgaagatactaatttagtcagggttcgtctagctaatggattanaagatatccacaag

SEQ ID NO: 6726 - DNA, 382 bp, Diabrotica virgifera
  Clone ID: LIB150-037-Q1-E1-F7
aaattgatccaaagtgtcacacttacagtcaaaatatcacaactttaaagtcagatgaaatggttcccgaagtgaaaatgtgtattcttgcacttgacgaagatcctcgagcagccatagctactgctgccttggatgaatataattcgcatgatcttgaagtgcctcataaacacacctggaatactgtcggcttcattcaagggaatagctgtaatgcaaaaagttatatctcgttagatgaagacactgataatctgaccttagacactttgccttctacagtaaaatactccgcgggattcaatcttgaaccgggcactgcatacaagttcatagtcgcaactatcagttcattaggtcgaagtgattggggtgaggt

SEQ ID NO: 6727 - DNA, 434 bp, Diabrotica virgifera
  unsure (1)..(434): unsure at all n locations
  Clone ID: LIB150-037-Q1-E1-G1
ttacttaaaagttataaaggtcaaggttccaacaacttaaaatccaaatttaaaataaaggtaaaaccacggaatggaccattcaccaaacttataataaaaaataataatccggaaaaattcaagaattatttcaagaaatattaagcattttcaatttgtcaatttactttttttcccccttaaagctcacctttcgatagtgttttggatcataacagtcttgatcaaaacgcagattttgtgcctggatcgctgagctctgatacacgtttattttatataatatatatccttttctttgtttttgaagaatgattttacttattttggaatgggacgtgtttatcgtctcttaaatgtaagtgttttgtgtattaaggtanaaattctcacagtttcgctagtttttaaagcatttaactctatttaac

SEQ ID NO: 6728 - DNA, 351 bp, Diabrotica virgifera
  unsure (1)..(351): unsure at all n locations
  Clone ID: LIB150-037-Q1-E1-G12
acaacaccctaaagtgagtcgtattaacncgtcaggttatagcaagagtcaatatatcttttatggatggacattgagatagttggtgtaacattccatcctaatatgaggcgaccagacatcgaattattgatcattgtatgacaaggacaaatacctgcttgttaaatatttaggattggccatcctatttttccgtttgccattccagctttaattgcgatctgctacttattctacgcattgcattgtatatgcagctgtctgtccatttggagactatataccacgttccataggtagtagggattagtattataatctatgtgcagcagatgttacaatcatacc

SEQ ID NO: 6729 - DNA, 423 bp, Diabrotica virgifera
  unsure (1)..(423): unsure at all n locations
  Clone ID: LIB150-037-Q1-E1-G3
cggacgcgtgggcggacgcgtgggatttcacaccaaattgtaccttttacctgggtgtacgtcacacggtgctggttctgtcaatatttttggttgttttagtttttttcgatgatagtttcgcgaagaatttacgattttattagaattatttctcaaaagaattttgctgcgttattaatttgagatagatatttattttatcagtttttcgtgtaatgatttatcaattttgtcggtcagttatcacttttgaagaaaatgaattatttaatgataggaagtgtttaggtctaaagatggtatttttatttgatgtggcaaaaccagtagtttttttgttttcatgtntttttattgcagtcattttcaattgtttatgtataaagaaaagtacatccaggtaacctttataccatcagc

SEQ ID NO: 6730 - DNA, 354 bp, Diabrotica virgifera
  Clone ID: LIB150-037-Q1-E1-G4
accctttatttttttttttagtcagagcatgtgtattttatttacatacttataatccatataacatttttcttgcaccgggactgcgacgtagtggtcttaccaaatatccggatcaatcaactatttcaactccttcagctgagaatatatcgtaatcagtctcgttttcgttgataattttcaaggacgatccatttacgccttgatgaacatactcttgggtttcgttgggttggacaacttgactgcggaacacttcctggtttcatcctttatcgtgaactatctaagcggtcaaagcttgaattccatgattatcgacggtgtacttatcattagcaatgggtttac

SEQ ID NO: 6731 - DNA, 108 bp, Diabrotica virgifera
  Clone ID: LIB150-037-Q1-E1-G5
cacaagcgtctacagtgagtcgtattaacaagtcacagcacatagcattttatacctgtgagtaagtcgtaagtcactcgttctggcaacaggtatgattgttatagt

SEQ ID NO: 6732 - DNA, 427 bp, Diabrotica virgifera
  unsure (1)..(427): unsure at all n locations
  Clone ID: LIB150-037-Q1-E1-G6
aggacgcagcgaaaatcgaagaacccaaatccgcagaagagaaactacccgaaccaagtgcgtccagttcttgaactgtatttccatgatcgtggaaatttcccaagaatgactgatgaggttcgctggcgcttttgttccacaacacacttaatttttttagtgaacaactgggcggaccgaacctcgaatagtagattttatttatgtgtgctcaaaaataaaaaaatcgtgttttgttatagaaacagtgttgtttttattttatagtatttttgttttattatttttttgtttgtttcgatcagaatcacattatttctttttgatttatgttaacgacaagccaggaattcattcgaccttatgaatctanacatagtttctcctctaatcgattaagtttaaggttatgtattaaaagctt

SEQ ID NO: 6733 - DNA, 389 bp, Diabrotica virgifera
  Clone ID: LIB150-037-Q1-E1-G9
aaataaaagtgacaatatttttataaacaccctgcattttgtatacaattcttctaacatattttgccatgtactatttatttgcagtggaatctatttttatttaagaatatttagtaaattccaaggattgtccctaaaacttataaaatttataattattttaaataaatattgtataaatgatcattttaaggatgtttatcgttaatacgcttcttacaactgtgtccattccagcaatattttatttttgtaaggataaagtaatgctcaactaagattacctattttttacatacatgatatgtgtatctatgtggaaagattagtgatgaaacgtaaagcattttatacttattgttgaagatattttgtacatatattta

SEQ ID NO: 6734 - DNA, 417 bp, Diabrotica virgifera
  Clone ID: LIB150-037-Q1-E1-H11
gatacaagactctaaaatgagtcgtattacgcgtccgcgttgacaatagttgacattgacatttagaatgaaaaataaatttttgaatttagattaaaaatggacaattctttgggatgttaaagtttatcaatctaaaatcttgtacttttaaattttaaactttcagtttagtctctttcgtataccattctttcctctacgaaagatgcagctgtatttacaaactgactctattttataatcaacaaaaaacgacataaactatttttctttgatcaacaagtctggaaaacaaatctatacttacctttaatatattttccaaaatgaatcaaaataaaattattaagtattcaccataaatgatgcccagcatttttaatcagtgccatccaattgccaatacaactgaac

SEQ ID NO: 6735 - DNA, 438 bp, Diabrotica virgifera
  Clone ID: LIB150-037-Q1-E1-H6
acaaaagggaattattgttccagtccaaattgtaaaatattaagaaaaaatcaaaatatttgaaaataattcaacatatcttctcagattttgtaaacaggagggaagttttttttttataaaagtgggaatttttaaggtaagttgacggaaaaagcttactcgacggttggcaacgccaaagcctttggttgctttggttgtgcagtttggcacgttttggttctgcggaatggcctattgaattgaatgtacctaaattcaaattccaaggatgtaaaaatactaatgattcatgataaactcgaaatggtaaagtcatttcaattatgaaaacgaatttttaatagtatctatgttaacgttaatataattaatgtttaaacttttttaccctacaacaattttgaaatgaaattcgtccaaaactacctacat

SEQ ID NO: 6736 - DNA, 420 bp, Diabrotica virgifera
  unsure (1)..(420): unsure at all n locations
  Clone ID: LIB150-037-Q1-E1-H7
actcgtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgaatctggagaaaagaaatcatcctccgagtcctcctcgagcgagatagaatccagcgaagtaaaaatccaggaaaagaaacttgccgaacctctcccagctatcanagag

SEQ ID NO: 6737 - DNA, 144 bp, Diabrotica virgifera
  Clone ID: LIB150-038-Q1-E1-A10
tcctcttaagccttagcgctgacaattcctgggattcacatttacaatgtgccacacatttttgcattgagatcgtcaatggacacattcattgggatgttatggttaatcaatctaaactcttgtgcttttaaagtttattca

SEQ ID NO: 6738 - DNA, 367 bp, Diabrotica virgifera
  Clone ID: LIB150-038-Q1-E1-A12
acatgaattccttcctgaaattttaaaaaagtttaaaattagttaaattgtaactaaactaacggcaaaatccgttaaatggttacaactgatcgtaggtatttttaggtaaactgttaaattacacatatggaaggaaaacaacacacagatatacatctcaaggcgatgctgagcaatcactccaagtttactccagctgttccagttcctgactggaatacaccatctacttctacaaatcctacaacaccctcacaagtacctcttataaaaccaaatttatgccttatgacaatagcaatgccctgggttcagcagtaggtgaaccacacacaaacataatgttacagaattgtctatctac

SEQ ID NO: 6739 - DNA, 427 bp, Diabrotica virgifera
  Clone ID: LIB150-038-Q1-E1-A4
accacgcgacggcccacgcgtcggcaagtggaatcgatcccaatcaaaatataaacaaaatgagttccaaagacaatagcgatgttgcagtcgacaaattagacaacgaaaaaagtacagatggcaaagcagagataaaaggaacgaagcgagcggcagaggacaaaacagaagaccccaaaaaagcgaaaaaagaagaaaatggtgcaaattcagacggtgaggatttagatgaggaagaagaagaggccattgaagaagaggaagacacgggcgaagaagacgtagttgaaggggatgatgaagaaatagaggctgaagatgaagaggatgtagagggcgaaggtgtagaagaagaagaggatgatgacgcataataaagtgggtgccgtcaaaccctgtgaactttacttggcggactatctca

SEQ ID NO: 6740 - DNA, 164 bp, Diabrotica virgifera
  unsure (1)..(164): unsure at all n locations
  Clone ID: LIB150-038-Q1-E1-A7
tgtatccattacagaanatgagaactcttctcttcaaaaacaaccaaatctcccttcaactgataactccattcgaaggtcttcaagttaaagatgtcaaaaagaccaaggacgtgattggattcaacgatgaacacgtcttcaccttctcacaatccaagaag

SEQ ID NO: 6741 - DNA, 170 bp, Diabrotica virgifera
  Clone ID: LIB150-038-Q1-E1-A8
gcgggtcgacgcaagcgtccagagtgcaggttctaatgtactttttcgtacatcgaatgcaggaggcgatggctgttgccaaatttccgcattgtgcagatgatagcttttcaaccaacgtagcgttagcagattgacacgctcatgagagcgtaacacaggccgttccg

SEQ ID NO: 6742 - DNA, 214 bp, Diabrotica virgifera
  Clone ID: LIB150-038-Q1-E1-B10
tccgaatcgacccacgcctccgattttttagaattatatttatgtaaataccaaattaatttacttggggtaataaacaagcaaatttaacttttctaaaccaattcaaattactgaacattttctgaatcgactcatggcgattgaagaagtatgtcacgtgcgggatcgaaccttcgtctaattgcagagtccaaacctctaataagaattc

SEQ ID NO: 6743 - DNA, 407 bp, Diabrotica virgifera
  Clone ID: LIB150-038-Q1-E1-B11
aatctatacaaaaagaagaagaagaagaagaagcatttttgtttggagaaagcgagatttgaagcaaacttttggagaaagcaagttttgaaacacactcgttaggagaaagcaagttttgaaacaattccctttttttgcatatggaattttacaacttgtgttttttggcgattttaatagaataaaagtaatttgcttgataatggtacaacagatctgatcgattccaatgacgatatagttcttggaagatcatgcctaaaatacgcaatttatccgttttttttttgtttttgcccattcatttttcatcggtgttctttttcttgcctttttatcaggtcctaccacttgaacatccattacgaatagacgagcaatattactgtaatactacttatttt

SEQ ID NO: 6744 - DNA, 406 bp, Diabrotica virgifera
  Clone ID: LIB150-038-Q1-E1-B2
ccacgcttcgaaatttttggcggtcaaaaatttaataaaatgttttgaaaaaaaatttttggttacaccaattacaaaataacttcaaattcacggaacaaaggctccaacccaaactttatttaaatacattgtcttatttatgttacaattaatctcgccaacatggcggattgattttgatattgtgtgatttttttaaatataataaatttataaaaaggtgtgttttttacgaatgttactatgtgaatgtgtaagttaggttagtttttcaagtcatcggtcgtagagttttcgtattacattccgcggattatttattatttttattactgcttttctcatttattgttccctcttatcgtgtgcctatgtatcgccagtgtataagaatagtgacgct

SEQ ID NO: 6745 - DNA, 386 bp, Diabrotica virgifera
  Clone ID: LIB150-038-Q1-E1-B5
acaatcttcagtaaatgggaaacaacgagagaaagagagagagaaaatgacgacttatttcaatttaaatctttgttttttatttgttaattcttcttcttcttcctctttataagcaattctgcttgttcagtgtgtaattgttaattatgcgcaaaaaaggtgatttttggaatttgttttaaaaattgtttaaacaatttgtgcccaaaaacttcgcctgactcccttcagatttgattaaagggcatattttttaacatgaatccgcaaagacaccgaaacatttttcttaagggaaaactcctgataacctggacaagtagtataactgtagtaatgtctttcgcttctcttgcttaaatttttttaagtttctgtatcat

SEQ ID NO: 6746 - DNA, 353 bp, Diabrotica virgifera
  Clone ID: LIB150-038-Q1-E1-B8
agtgaagtctcacacaaagttcagtgcaactggtcacgaatggatgggaatctacaccggcatgtgatcactcatacatcatagaacagtaatagctaaccataacaaaatatatctaagatagtcgtcatatcggaatttcaatgatatcaagctgtttccacccacgtggacatagagcgtgcgctatctggtacaaagatgactattattaaaatagtatagacagttgatattgtgtacactgtctaatgcatccatgttatatctagtcggctttatatagtctcctgatggctcaatggattaaccccctatttgagctcagcaacgcactgaacattgctacaagc

SEQ ID NO: 6747 - DNA, 423 bp, Diabrotica virgifera
  Clone ID: LIB150-038-Q1-E1-B9
cacgcgtccaaataacattaattattgtgatattctttactggtactgggagtattcctttagaacaaagtgatcacactaatcagagtaatcacattatcacaaataaagatggctgtttatcatgtaagataccgaacaacacaccagagcctccttcttgtggaccatgccaaagcttagtgtttaataagtgtaaaaacacatttaataaacaatgtccacgtaatccccctgcccgtcaggccaattaacgtacgacgatatacgcctactatgattacaaagatggaggaaatactagtgaatattacttattagatagtaatttagtccttgagttaaactagtcagataaatataccacaaataagaaaatatctaatgtaactccaacttttgctataagtttattcctataac

SEQ ID NO: 6748 - DNA, 384 bp, Diabrotica virgifera
  unsure (1)..(384): unsure at all n locations
  Clone ID: LIB150-038-Q1-E1-C10
aatagtaaagaaaaagtaaattaaattgagtggataaatgcggcaaaaaatttgtaaaccaattttaaccaaaagggtaacgaaaccaggaattaaattccaccacaaatcccccatttaaaaccgggcaatacgggttttggccaacataacaaaaacgttttggaaaacacttacggtacaacaacacacaaagttttacaaattcaaacattacacacagctgaaaaacttgttttacctgacaaaacggcaaatgattaccaaacctaccgacctgcancaagagatatcgatattgtgaatgaaagacatggagacacgatttataagcatcctatggtacctggatatgaaggtttcgtancgcgagaacatggcaaa

SEQ ID NO: 6749 - DNA, 416 bp, Diabrotica virgifera
  unsure (1)..(416): unsure at all n locations
  Clone ID: LIB150-038-Q1-E1-C12
accacgcgtcagcccacgcgtccgcggacgcttggggttttggcaaaccataaacggacaaattgaacaaattttaagttaacttcggttggttggtcctggcggcaaccggtgtatttggcgcaccaaacaatggtggaaaacctaaaggattggtcaaggaagcagatctgcaaattcctgaactagtcaaaccttacatcggcgaacgtaaagtggtatccaaagcactgcaaaagtatcttaaagattccgattatcaagtaataaaagatctaacccgtgaattcgacaaacacaaggacaagtgcgcagatatcgaaaagaaaatgaatgataccatcgacgacctcgccaactgcattgaagatatcaccattggtgatagtaccgtctgcgcntacgcccaacgtgcc

SEQ ID NO: 6750 - DNA, 403 bp, Diabrotica virgifera
  Clone ID: LIB150-038-Q1-E1-C2
agggagttaaaaaaatcagttttcaaaacagaaccaatgaaaagcccaattaggagcaaatgcttttttacaaaaataaaacctcaaaaataaaaaatgaattaggaaatgagaaattatccaaaaatagataaaaaagggcctgcggttaagaaaaataaatgactgtattccttttattataaatttatactctattcttttatattgcagcttttggactttgagagtttaatcataaacgtgtttatcacaccataccgcctaaatttctattgtcgtatttttatattgttttatatatgaaataacgcattaacaaaaatatttacacgctgtaatttggtttcttcattttacttaagttgaaagctttgatccgtattagaacctactcatactc

SEQ ID NO: 6751 - DNA, 402 bp, Diabrotica virgifera
  unsure (1)..(402): unsure at all n locations
  Clone ID: LIB150-038-Q1-E1-C4
agcaggatataaattttgaaaaaaggaaaatgaatttgatttaaccccaagaagaatttgataaagaaaatggttattatggaagggcttcacccgaaccaaggtatgtgcgccatgttgagtatccggcacgaccacctccagaagagtattatggccgcagacaagttgtctacgaacaacaagattatatgccgccacctcgtgagagagctcgaccttatcgcgaacttccaccgcatcgtatgcctgattattatagcaataagtacaatgaggaggaagcgcctccacattccagcggaagtaccggtaaaagaagcaacaaaccaaagcgagaagtgattgttcaaagggttgaaagcgagcgcccatcctcangaagaagggatgaatggcaag

SEQ ID NO: 6752 - DNA, 409 bp, Diabrotica virgifera
  unsure (1)..(409): unsure at all n locations
  Clone ID: LIB150-038-Q1-E1-D3
agaacctcgaatgtgtgcaatgatgagcctccaatactgtggattggtccttttggcaggccttttgttggtttccgcccaccctggaaccgactctaaggttgaagccaaggtatcttcagtagccgagaagaaacaggaaaaacgtggtcttcttgatctaagctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcncgtacacatcgaaaagaaaataccagtttcagtgccagtcaaagtacctgta

SEQ ID NO: 6753 - DNA, 426 bp, Diabrotica virgifera
  Clone ID: LIB150-038-Q1-E1-D4
tttgaaaatcaaccccaaggtcattataaccaacaaccaacccctatttctggattttaccaccaaaacggacaatatcaacccgctggacaataccaacaaactggacaataccaacaaactggacagtaccaacaacctggacagtaccaacaacctggacagtatcatcaatctggtcaaattaaacaagttcaacaaccaggaccccttcaacaaggtcaatattatcaatcatctaaatcgcaatcttctggtcagcaccaacaacctggtcaataccaaccaactgatcaataccaacaaactggtcaataccaacaaccaggtcaacaagtttctgttcagcaattaaccaatcctaatcaaatcgattacactggagcatacagtgaaaagcaaaactcttacgcaaacccaactcca

SEQ ID NO: 6754 - DNA, 239 bp, Diabrotica virgifera
  Clone ID: LIB150-038-Q1-E1-D5
aatccggtcaatattggcaccgaacagcatgacaaatctaattcggtttaaagggctccccgcttgtcccaagaatcatgtcataattacaccggtaatagacgtgaattcatcgctatgctgatatatctccagatcatgtcatcagggagacaaggcagtattagtatctattcgtgagtgaagagatacttttcagaaatgagctgatacagatatgttaagggaatacctgttta

SEQ ID NO: 6755 - DNA, 422 bp, Diabrotica virgifera
  Clone ID: LIB150-038-Q1-E1-D6
aaaaatattttggtataccttgttaggtcctatttacttatcaatggaattttgaataagatggagactcctgttttaactaaaaagcaacttaaatcaacactttcagccaaaaaacaacgaccaaaagaaacaataaaaaatgttttggctttacctttcaataataattattggccggaagtatcacctgaagaccagaaggaacttaaagatcttataatacaacacatgccaatgataagagataagcagattaaagttccatggaaagagttaaagacagttccaaaagcgaatagaaaatcgtttcgaaaagaatacaatgaaaaacttcttggaccccaaccccccaaaaaatgctgttctggaattagtttcggaatcaacagcatgtcaaaattgttggaaaaaaattttgc

SEQ ID NO: 6756 - DNA, 418 bp, Diabrotica virgifera
  Clone ID: LIB150-038-Q1-E1-D8
atgaacttgatttacctgaccttaataattaactgcaaaatctgtgataattcaatacatgactaaatttctcgtgcttatagataaacttcatcataatctgtgttgacatgtctttatgtagtttgttgtagtcattaccttacatatttttatgtttatggaagtttattacagtgaaaataagttggaggaggactccgatgcaaacaaacagttttgtcttacctttttgttaaattgtaacaactaaaacattattactgtatataaagtatgtaaatgtactaaaaaatggcatttctatgcccagtgagaatcagacgaggtaaaaagaaaaaagcctcgaatatagatttagaaaaagaactgactagatctaacaatggtgctacaccaggaatgggaagaattactg

SEQ ID NO: 6757 - DNA, 406 bp, Diabrotica virgifera
  Clone ID: LIB150-038-Q1-E1-D9
aggatgactataactgtttggtgacagttacaataggtcagaaataccctataaaaaaacctacggtattacggtcatcattgtattgcccggaatcaaaagcatgcagtacaatcttaccaaatatccctaaaaaccccacgttgaagccgaaagttaatgtggaacatttaatagagttcttgcacgacgccgttctaatgttcaagaatcatagacattaattataatattttatataatatatgtatactgtgctgttcgaatgaatagacaaataaaaaacaagtttttataaccttagcttttaatacgtaccataagtagactgaacaatctatatattagtacgaaatttgtcctcgtttagcagaagtgaccttacacatctaggcattccctctcc

SEQ ID NO: 6758 - DNA, 378 bp, Diabrotica virgifera
  unsure (1)..(378): unsure at all n locations
  Clone ID: LIB150-038-Q1-E1-E10
aaaataataaaatatttttaagtaaaattaaggaaaaatttaattaatggaaatttaataagaatggtaaaaaataatttaattttaataaaggaaaaattaatttttggaacctggggaaccaggaataataaattaataattaaaaattaataatttccgaatttaaaaaacctaaaaaattaaaattttaatggtaaaataaaaatttaaaataattttttggtaaggaaatgtaatccgtttttaaatatacctaattttttaagaaataaattaaaattaatttattagcaatatatttataattaaatatttttatattattaatattaaatatttttagggatgagcttanaaataaaattttattaaaat

SEQ ID NO: 6759 - DNA, 418 bp, Diabrotica virgifera
  Clone ID: LIB150-038-Q1-E1-E11
cccacgcctccgaagcaacatgacagacatctcaaaagaagatcttcgcaaagaaattgccgccatcttaaaagatgccgacctttcatcaacttctgccaaaaaggtgaaacaggacctaaaggagaaactagaaacaaatctacaatctagaaagaaagaaattgacgatttggtaatggaattcgtcagttcaaagcaggacaagaagaagggcggtaagaagaaggcagaatctgaggaagaggaggaggaggaagaagaagaggacgaagaggaaccttctgaagatgagaaaaagaaaaaacgcgcctccactggtaagaagccagcagcaaagaaggcaaagaaaacatcagaagatgaatctgccagcgaacagagcgatggcgattctgaagaagaatattcaaccaaa

SEQ ID NO: 6760 - DNA, 360 bp, Diabrotica virgifera
  Clone ID: LIB150-038-Q1-E1-E5
agtccaagatgagagtactcaatcatctttctcacgtggccatgagcaacagctcattatgatccaaatatcaactctcccttgatgtctactaaattagcgtggccgctcgaaccctggccacgatgctctggtaggactatgcaatcatctacattattgacaacaggaatgaaaggattgggtacaatatggtggccataaccaacccgataactactgtaagcagtacgtgcaacgcatcaaccattctgaaaatatcaatataccctagatatatcactcttgggatgactaggttgtgcaagacttaactctagttcaacgtgatcagtagctactcaggatgatcagacttca

SEQ ID NO: 6761 - DNA, 405 bp, Diabrotica virgifera
  Clone ID: LIB150-038-Q1-E1-E6
acccacgcgtccgcgtcagttgaacttgcgtgcaatttttttttctgtggtagatctgttttgttgatagtgatactacagttgggaggttgaggaccctcatttaaaccggttccattgttcatgtgcttcaaccaaatcgtaatacactcatggaagtgactcaattagtgacttaaattttgttgactttttatcgaaaactactgtgtttataaatagcaaagtaacaagaaatcaaactaaacaatattagaaatctgtgggaagttgataattgttgctctcctgtaaaatacagtaattgaaaatgaagatcttagcagcccttgtcttattatgcacactaaactatcacagcagtttggctagcgatgacggatttaaaggcattatttccccaac

SEQ ID NO: 6762 - DNA, 424 bp, Diabrotica virgifera
  unsure (1)..(424): unsure at all n locations
  Clone ID: LIB150-038-Q1-E1-F10
tgacaagcgttcgttaatttaaaataataaaataatttttaataaaagttaagaaaaattttaattaatggaaggtaaataataatgggagaaaataatttaattttaataaagaaaaaattaatttttggaacctggggaaccaggaataataaattaataataaaaaattaataatttccaaatttaaaagagctaaaaaattaaaattttaatgtaaaataaatatttaaaataattttttggtaatgaaatggtattcgttttaaaaaataccaaattttttaggagataaattaaatttatttattagcagtatatttataattaaatatttttatattactaatattaaatattttagggatgagcttaaaaatanaattttataaaattaatttttaaataaaaattggagtaaaaa

SEQ ID NO: 6763 - DNA, 354 bp, Diabrotica virgifera
  Clone ID: LIB150-038-Q1-E1-F12
ctaaccttagccagaagcatttcagttaggaaaattccccaatagactcccaaattactacgggaacaaaataataactttccaaataagttaattgtaaaacttgaaggtgaacccggttaccaatgccatttcaatattaaacggccaaatgatcttggactagaaaatggtaatggatgctattcagatggtcataatattgttatatgtaaacttggaaccaagctggataatctaactagatcgatcagcgttaattttgataagctccctagtccaaatctgaattattcgaccttggacatcatatttgagttatcctgtcgtcatggacaggacactgcatcagat

SEQ ID NO: 6764 - DNA, 392 bp, Diabrotica virgifera
  Clone ID: LIB150-038-Q1-E1-F2
ccaggccttcgaactttttaccaaggctccggctttggcgcctccaacaaaatgggggtacttgcatgaatgaaaaatagttatttatgaaacagttcgggaagtatgctttttgcaaacgcacgcgatgtttaaagcacgagcgacagcggagcgagtgatatacttcgcgcaagttcgcaaaaagtgcttcacgcacagtttcatacaatattttatctacgataaacaaataaaaaaactgtaactcttcgtcactggaattcatttctattctacaatttttagaattttggcatttaaaaattctaacttctttcaaaccacaaaactgtcaaaacatttgttgtaatttatttctcattatgtcatcaccatgacaacgccaaagt

SEQ ID NO: 6765 - DNA, 396 bp, Diabrotica virgifera
  Clone ID: LIB150-038-Q1-E1-F3
aagacgcgagggtggtattaaaattcttctcctttgtgtacaaggtcctttcagaccgttggttaccaccatagctatgtaaattttatttactaccatcctaaatatcttgcttgtatcaataccataccaatttcacaagttcttcaaccatgcagttcttcttcgtcctggactgcgtttgccggtcattttcccttgcataatattttgtagcaacctatatttgggaccttttactacatgtccgaaatactctagctttcttttgtaaggacataatatatgatatatttaactatattgagaagaataattttttttcttaaaatctcactttcctatttcatgaattactatttaaaacggttctttttcacgatttaagccactttg

SEQ ID NO: 6766 - DNA, 361 bp, Diabrotica virgifera
  Clone ID: LIB150-038-Q1-E1-F8
agaaattatgcatcttacacatcaagactagttaaggggaatttagggttctcccatctctacgatatttcggacacacagatactaacataatttcgaacatgcacttgtattctacatactcgcaacataaggggtccctatgttgcgactacattatcgtattctcacgttaactcactagtaatcacttgcagatcaatttgatagtcaacatataacagaagacaattatttaatatcaatttgatatagtgacgacagctttaataagtaaaactgcacctaagtgctacgaataacctactattattaaaatgcctctactaagaagtcttttttgaaggggtaaaaacttttt

SEQ ID NO: 6767 - DNA, 302 bp, Diabrotica virgifera
  Clone ID: LIB150-038-Q1-E1-F9
ttgccaaaaccggtccaaccttcaccaataacaacctggttgataaccggacgggcaacttcttggaaaaccattaccatggccaacggaacttacctggaaaagcccccaatttacaaaggatgatggaaaaacacggaccccttggcaaatggctctaacacaagaacctcaaaggagcctcctcataatttcattaaagttgtaaatatttttagtgcagttttcggtttgacgtccgtgaaactgtgttacgtgatatagtgatagttcctatcattttttcttttttgtaaattgta

SEQ ID NO: 6768 - DNA, 95 bp, Diabrotica virgifera
  Clone ID: LIB150-038-Q1-E1-G10
atattaattaagagaaactgtgttaataagtgtaattaaccacttttaataaataaatgaattaaagaataaaaaaaaaaaaaaaaaaagggggg

SEQ ID NO: 6769 - DNA, 399 bp, Diabrotica virgifera
  Clone ID: LIB150-038-Q1-E1-G11
gtccgcccactcgtcaggttcacccagcattcagtatatcaatcgtcgatggacattgtgcaatgttggtatatccttccgtcggaatctacgtgagcatacaacgcatgattgatcttcaaaggatgtcaccatacacctgcatggttataattaatgcatggacgtcctgtttttctgtttgctatccagctgtatatccgatctgctacttaatctactctgtcagatctaccgctatctgttcattggtgacgataaccacaagcaacatgtacagatagtacttcttaaagtgctgccatggatcactctgtccaagcattatcgatgattactatgtgcatctacaccataatggcagagcttatctgtacatttcttcaggaaagatctgtg

SEQ ID NO: 6770 - DNA, 195 bp, Diabrotica virgifera
  Clone ID: LIB150-038-Q1-E1-G12
gaaatccccagaatactctgagtaaggagacatattggaaagtgccagtgagtggattggcagattaacaaatgtagttgtctgattttactcgcctttttatatgattatgcagttaccaaattgtgcttttagtgattttactgattttacaaggtgatacggtcgagacatgtaccgcctttttaagcggcg

SEQ ID NO: 6771 - DNA, 442 bp, Diabrotica virgifera
  Clone ID: LIB150-038-Q1-E1-G2
tccaggcctcacgatagacttgtacgggtcaattaatatgatgcctgcgctctacacaatattgttattaatccggcggtggactgaagataaagaaactaggaatcaccacaagacagttacggaactttaagtagtcccagtttagatatttcggacacacagacaagagcagcatttcgaaaaacacttgtagtctacatagtcgcaacataaggggtccctatgttgcgactagactatcgtagtcgcaggttaattcactagtaatcactggcagactagtttgatagtcaacagataacagaagacaagaatttaaaatcaatttgatatactgacgacagctttaataactaaaactgcacctaagtgctacgaagaacctactattattaaaatgcctctactaagacgtctttttggaggggtagaaactttt

SEQ ID NO: 6772 - DNA, 424 bp, Diabrotica virgifera
  Clone ID: LIB150-038-Q1-E1-G3
accacgcgtccggccaagccaacagtgagtgttcaaagaacgtcggacagagctcattgtactgtcatcttggaagttacgctattagctacgttatggaaaaatcactgggatcttcattcgacgtcttctacgaagcgggaagaagaggaagatacggtgataactgccaggagaagtatttagaatgtaacgaagtataaaaacaaaacagcattggactcagaataacattttcgcgaaaaaaccaatagataggtacttatttaaactgaacagagcgactgggaaacaacagttgtacagatttttaaccgtagtaattataagaactttacagtatattttagtattaaattaatcatatatatggcactgttctatggttgtttcaactgttagaaacgtaaaaggtgcgtagtca

SEQ ID NO: 6773 - DNA, 377 bp, Diabrotica virgifera
  Clone ID: LIB150-038-Q1-E1-G5
ctcgacccagtcaacataagcatcatgaactcttacagtgtggtatttgcgtttgcattggccgctgttgttgtagccgaaccaccttctggctacaactacaaccggcccagcgggggtggcggcatctccttcgggggaagcagcctctccttggggggtggactgtccggcggtggtggatacacggctgtatcgtctggtggtcaaactagcgaaggagcttccgtagacccacagcttctcgaacaagtccgtcaaattctgctcaaagaagaacagagctcttccagcggcggtggccatggtggtggtggtggatacccaggaccatcttcccaatacggtgctccatctcctcaatacggagtacccag

SEQ ID NO: 6774 - DNA, 349 bp, Diabrotica virgifera
  Clone ID: LIB150-038-Q1-E1-G6
aatttttatttattttaaaataataaaatattttttagtaatagtaaacaaaaatttgacttaatgatagttaactaggattgtccgcgaacctgttacgggtctttaatgcatctttattctaccgaaccctgactatcatgcacaagaatcatttcgaataggcgttcctgacgttccagccccatctaacccagtaagtaccttgtttattccacctcaaaacctcatcataatatttttgtcatccgatgtccccccattataaattcctcttgacgcctaagttgatctttaaaatcaatttgatacatggccattagaattcaatccatttaggtcagtcaac

SEQ ID NO: 6775 - DNA, 420 bp, Diabrotica virgifera
  Clone ID: LIB150-038-Q1-E1-G7
aataagttacttcgaggattgtaaaacaaaatgttcgggattttcgttttcgccattttttctgtcgctgttgcttcagctggcgtacctaaacatcagcacgtgaaagtcgtagttcccgaacaacaagctcaatcctcgcataccctggaaattgccgaaggctatgaaagtggtggctatgcgcctggtgaattggaggcccacgcggcagccgaagcgggagccggtggaagtggaaaaggcagttcaggagcagaattaacaagtttggctcataattcggcagtgcaggctaaaaatgcggtcaggaatcaacataccgccggaagccaagccgctttcggtgtcaaaagtagtttagccagtgctgctgttggagctgcccataccgctcaagctgccctagtgggtaaacaa

SEQ ID NO: 6776 - DNA, 206 bp, Diabrotica virgifera
  Clone ID: LIB150-038-Q1-E1-G8
ccagacaacattacgatcagaatggatgtcggagtacctgatcctgaaccagaccccgtccaggtcgcaaaagactctgaccagcttccacatgcacagtcaaaggtacactgtcaccaagtagcatccgaccattatgccatttggatgtacctaaaccatacccggttccagtaaagaatttcctagtggaacggttcctgctt

SEQ ID NO: 6777 - DNA, 403 bp, Diabrotica virgifera
  Clone ID: LIB150-038-Q1-E1-G9
caaatttccaaaatttccggttaaaatttaaagggatttaccaacaaccaaaccaatttttggtcccaatttttaacagaattaacttattccgggcagtgttaatgagatataggtacattttaggaaatatattgcttaagtagtagcaaagaatctacctgccaaatttcaaaattttcggatcatatttagagtgacttatcaacaataaacccattttttgtactattttttacattacttaatttagtccgtgcagtgtttattgagatatagttacattttaggaaatatattgataaagtattagcaaggaatctacctgccaaagttcacgattttcggatcaaatttagagtgatttaacaacagcaaacccattttttggaccaatttttta

SEQ ID NO: 6778 - DNA, 418 bp, Diabrotica virgifera
  Clone ID: LIB150-038-Q1-E1-H1
catgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcaaagagccaattaaggaagaagtgaggccaatcgatccacttcttgttttg

SEQ ID NO: 6779 - DNA, 351 bp, Diabrotica virgifera
  unsure (1)..(351): unsure at all n locations
  Clone ID: LIB150-038-Q1-E1-H10
aatatatttaaaaataaataattttaaaataataaaaataaataattttaaggatgaacctaaaaataaaattttaataaaaattaaaattttaaaataaaaattaagaataaaaaatttcaaaatttaaaaataagttaataattaattttataaaattaataattttaattttttataaattttttattaaaatataaatttaaattatttaaatttagtaatgatgataatattagtattaaaaaattgtatatttagtanaaatatataggtttaatanaggaattcngcaacattttttcaactgtntattanaaacatgtctttntgtantaaatataaagtctc

SEQ ID NO: 6780 - DNA, 400 bp, Diabrotica virgifera
  unsure (1)..(400): unsure at all n locations
  Clone ID: LIB150-038-Q1-E1-H4
cgcgtctacattgcagaaggtcttattgaaccangatccaatggtacgactattataagaactggatggtggattaaggaaataaagcaagctgtaaaaaggaagaaagaaatgtggaagcgatacataaacacaaatcaagagcaagacagagacgaatacagaagacagagaaatatagtgaaagaactagtaaaagatgcgaagaagaagagctggaaggaattaggtgaagaattaaacgaaggttttgggaataacaataaacagttttggaataaaataagaagcatgaaaggaacaaaaaggaaacaaataagaggaattagaaatgagcgaaatgaattgaaaacaaacatacaagacatactaaccatatggaataagcactattaagaaa

SEQ ID NO: 6781 - DNA, 289 bp, Diabrotica virgifera
  Clone ID: LIB150-038-Q1-E1-H5
aatagatctgtcatcacaagaatactcagttgaagatatcattggaatttttactcgaaaatggctttaatgttagcttcaagagtgtgtagggcatctaccctagcgaaaacgactgtttttgttaaacagcccaatacgatcaccgtgtaccgagcttttagtgaaggcaaagatgcagctgcaagaacagctagacaacaagttggaataaaagagaaactcatgcaacctgcaggagatacagctttcagaatgggcaaaagagccttagcaggagcatctgcac

SEQ ID NO: 6782 - DNA, 367 bp, Diabrotica virgifera
  Clone ID: LIB150-038-Q1-E1-H6
tgagtcgtaatataggtcatcacaagaatactcaattgaagatatcattggtatttttactccatataggctttaatgttttcctcaaaagtgtgtagggcatctaccctatcgaatacgactgtttttgttaaacatcccgatacgatcagcgtgtaccgagcttttagtgaatgcaaagatgcagctgcattaacagctagacatcaagttggaataaaagagaaactcatgcaacctgcaggagatacagctttcagaatgggcagaggagccttagcaggagcatctgcacttggcattggagctttggcattctatggtctgggattaagcagcgaagctagtgcacttgagaaacaacatt

SEQ ID NO: 6783 - DNA, 425 bp, Diabrotica virgifera
  Clone ID: LIB150-039--Q1-E1-A2
acggacgcgtgggtttcaattgccgtcatattagatacgctattttgtttttatttcaaaaagaagttgtatttatgtaatcaacaatttcaaaaatctcgtatatgtattatgaaatttcaaaaaaaatgtggctttaagataatataatttctttccgccatattgaattcgcaattttgtttttcaaaaaaaaaacaatgctatgtttataatcagcgtccttaaaactctttaacatcaaatttcgaaaaaatattgcgtattgattaatattttcaatttctttccgccattttgtttaaaaaaataatttcagatttgtaatcagctattttagaaataccttaaatcactaaatttggaaaaaatacagcgttttgattgatatttttaatttctttatgtcatgttggatccgccac

SEQ ID NO: 6784 - DNA, 387 bp, Diabrotica virgifera
  unsure (1)..(387): unsure at all n locations
  Clone ID: LIB150-039-Q1-E1-A10
accacgcgtccgatggaagttcagaatctgaagaaaaacctgccgtaaagaggaaatctacaggcggtggagatgcaacagacagtgtggacgttgagagcgccacaccagagaaaaaagccaagctggatgaaaaagaatcagcggaagcgaaagcagatacagaagtagaagcctaggtttctcttgaaaatatattcgtgttcaaaaatttcttatgtttttatatatgtatgtaattaaataatgtaaaatgtangggcanacctgtgtgaatattttgatctagccctaacattcgacatattttataacataacacaaataaattttagaaaaatcgcatttaatttttagttaatgttgcacttaaaagtagtgaaaaat

SEQ ID NO: 6785 - DNA, 390 bp, Diabrotica virgifera
  Clone ID: LIB150-039-Q1-E1-A12
acagtcgttagtagaatatagtgatttcgtcagctatgttcaagatgacaatgttaacaaacttgttaaaaattacactatgcgtcaaggggtacgcccaaaaatttccatctggtcctccgttttcctggccaagttggacaaccggctggtgacaagccagttgaataatcccccaaaccggtaactttggagaaaaattgggtaaacttccgggaacatgctgtccaaggtgtgttccgaatgactggtcagttaaattgtattacagtcaggtgtgattttccggcttgtcagataggcactgtatcacagaaagtgtattgtaagtgttgtccacagtgtgtgcctattcgttcaagttgaagaagatgctgctatgagtattag

SEQ ID NO: 6786 - DNA, 205 bp, Diabrotica virgifera
  Clone ID: LIB150-039-Q1-E1-A3
gtccggccacgcgtccggccaagcgtccgcccataataaaatattttataatggccttagaaatctggacagtttttaaaagtcgttcaaacgacttttttaagccgtaaacaattttggaaataatacaaaattagtggtatcctagtaaccaattcccaagggagcctaatttggaaaaaaaaaaatcctggggtttaacaac

SEQ ID NO: 6787 - DNA, 439 bp, Diabrotica virgifera
  unsure (1)..(439): unsure at all n locations
  Clone ID: LIB150-039-Q1-E1-A4
cacgcgtccactcaaaaagacgcgccgaaagaaacccctgctcaaaaagaagtacgagtatctaaagaatcacctaaggcagctcanaaagatgcgccaaaacagtctcctaaggagacacagaaagattcaccaaaggaatctccaaaagaacctgaaaaacctgcacctaaagcatcgacacctaagcaatctcctgcatctaaaaaaggtaaaaaggatactcctaaagaagaatctaaacaaaaagagactgctgaattacctagttccaaagtaacagaacctacacctcccacgacacccgtctctccccctgtatcacaagaatctagttcccctagtcccgtttctaaagcagaactacaagttaacgccagtgtaccagaaacaccacctccagccccttcaacagaagccgcaaaaggccctactcctc

SEQ ID NO: 6788 - DNA, 392 bp, Diabrotica virgifera
  unsure (1)..(392): unsure at all n locations
  Clone ID: LIB150-039-Q1-E1-A9
accacgcgtccgcccacgcgtccgaaaagtgtatgttgtgatttttctcttgctcaccctagccgccatgggattctagttgcganaaaccttgcacacgcaagtgttgcctaaaacctaattaataatacaagcaataaggcgcctttttcgtttaaccccgttccgggacaatcgctatctttacttttattgggaagtctttccgaagcaagtaccataagcagcaccgtcctcttccacaatgagttctgtgctggtatggaaacaggagccggcctcgccgtcgtcagactatgacgaggccgctcttctcgacgccactatctataatgcgaccccatttgaattagacatcaaactcaacaatgaactcgacaatctggcagaat

SEQ ID NO: 6789 - DNA, 412 bp, Diabrotica virgifera
  unsure (1)..(412): unsure at all n locations
  Clone ID: LIB150-039-Q1-E1-B10
aagcattcacctaaaatgaaatattttgttttgttggtaagcattgtcgccattacagcatccgacttacaagggtaaacccgtagaacaaatgtttaatgcanaagacgaaacttcactcaanatctaacaaatcaaactccgtccaaagccaaatgcccgaaattgaaaggaaggcaaacgatganatgattcagctggactccgatatggaatacatggacaataggttcgaagcccagaacgaaaatttggaagaactcgaaagtgcacttaccatgcttcgttacatccaactccaaactctacaagagctttccagtcaagaccagattctcaattgcattgtcgtcactgttcaaaacatcgatgtccaggttaaaaatgaaacaacacatgtcaaccagcagac

SEQ ID NO: 6790 - DNA, 222 bp, Diabrotica virgifera
  Clone ID: LIB150-039-Q1-E1-B12
aggacacgtgggtgtcggtgaaatcggtgctgttatagtaaaaaacaaacacaatgggtcccaaaacgtaataaaaatgattccaaaatgtggcaatttctcacacaaggaattgggcaaaccaattccgtcaaagacttggtttaaacaacccggccgttaaaattcgcaaaaaggaataatcgtattaaaaaagctcttgctattgcccctaggcctgct

SEQ ID NO: 6791 - DNA, 299 bp, Diabrotica virgifera
  Clone ID: LIB150-039-Q1-E1-B4
agctccaatcacgtttggttcagatgattgactgggactatcgtatgcatggatgcacgcatcatagttcatgctgtccaagatacagatcttcatgcttatggtgcataggaaatatacgacagttattattcgtcacaaataactacatcagccaatacgcccttagtcactgctacacctgtaagtccagttactcgcagagtatgtcgcaaatttcatttccgaaaacgtcctcctaaaatttacacgcatcaagggatttctaaacgaagtcatgaagttttagaagacaggga

SEQ ID NO: 6792 - DNA, 62 bp, Diabrotica virgifera
  Clone ID: LIB150-039-Q1-E1-B6
aaaaaaaaaaaaaaaaaaaaaaaaaaaaaaaaaaaaaaagaaaaaaaaaaaaaaagaaaaaa

SEQ ID NO: 6793 - DNA, 418 bp, Diabrotica virgifera
  Clone ID: LIB150-039-Q1-E1-B8
agcttgtcaagttaaactttattctacccaataataaagacgaaaacagcttggctactgcgttcatcattgtatacgagaataagttaaataaaataattataaatgaaaaaacataatagccaggggatagtggaatatgaaggtgtaaacacgaggtaaagttcaaaccaaaccctgatgccccaagtgcatcattaattttaacgtcatatatgattttaagaatgtcccgaatcattgcatgacattttagttaaatctgagagttgccagaatatttttaaagttataggtataatattaacctagattgacaattgtcatttacccgttgacattgtgaaagtcagtactgtcacgatcgagtacttttacgtcaaattatctttattcgcatcattgattggttatctat

SEQ ID NO: 6794 - DNA, 385 bp, Diabrotica virgifera
  unsure (1)..(385): unsure at all n locations
  Clone ID: LIB150-039-Q1-E1-B9
accacacgtccggatgaagtgtctagttcttctttccctagtaacccttagtgtagctgcctactacccaagtactggtaggcaggtgacagtangagtaactggaaatgtgaaactagtcggctctcaaggttcccaaatttacattcgtaaaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtactgtagatgaccagaccttctacagtttgttgaacaaacttcaacat

SEQ ID NO: 6795 - DNA, 429 bp, Diabrotica virgifera
  Clone ID: LIB150-039-Q1-E1-C1
atcttgaaccacgtttctgatgtggatggagcagagtttcccaatgaaaacgaatctcctgttagacccccaaggcgcaaaaataaatcgaaggtgtctttttcatctgaaactaaaaccggaaaaacaacatccaacaacaaaataaacttcgacccgaactcttttacttgtgcactacaaaacatcctaaatttctccatacccgaggacgattcttgggacttggactccgattcggaaatgagtgaatatgaagaagataactatgtcaaagatcaaagttacgaaaccgcgaaagataaaaataggctgcaaaaatatatggaagaaatggaccgcgaattagaaggaactactattggacaaagttttgagaagaagaacggagataatttcgaagatatagagaatttcaagccggtcgag

SEQ ID NO: 6796 - DNA, 436 bp, Diabrotica virgifera
  unsure (1)..(436): unsure at all n locations
  Clone ID: LIB150-039-Q1-E1-C2
tttttatttattttaaaataataaaatattttttagtaaaaggtaagaaaaatttttatttaattgatagttaaatagtaatgtgagaagaatatttatttttatataaagaaaaaatttattttttttgtacccttgtggtatcaggggattaattaaattataaaatttaaaaaattattattttccaatttaaaaagaagctaaaaaaattaaatttttaatggtaaatanatattttaaataatttttttgtaatgaaatgttattcgtttttaaatatatccaattttttaaganataaattanatttatttattaacaatatatttataattaaatatttttatattattaatattaaatatttttagggatgagcttaaaaatagaattttattaaaatttaatttttaaataaaaattaggattaaag

SEQ ID NO: 6797 - DNA, 61 bp, Diabrotica virgifera
  Clone ID: LIB150-039-Q1-E1-C4
aagggggtaaagtttttcaccattcagattgaaaggggtattcaaattactgcagcaatat

SEQ ID NO: 6798 - DNA, 55 bp, Diabrotica virgifera
  unsure (1)..(55): unsure at all n locations
  Clone ID: LIB150-039-Q1-E1-C8
tactacacctatagtgagtcgtattatntggcagatgtaacatctgttcacgaac

SEQ ID NO: 6799 - DNA, 261 bp, Diabrotica virgifera
  Clone ID: LIB150-039-Q1-E1-D1
aggaagagttcaccaagtagaacttcttagaacctttaactgcagaatcagaggagttttggttgttaagccagaagatgccgatgctgtttggaatttgatcaagaacgaacgtgctacgattgtacgaaaagttgtcagaaacgaaaaagatcaagtgatagttcacaacttctctgaagtgatggaagctgcaatgagaaaatacgtcccaagcgtcgttgagaatacacctagtttgaacaaaaggtaagagtttta

SEQ ID NO: 6800 - DNA, 418 bp, Diabrotica virgifera
  Clone ID: LIB150-039-Q1-E1-D10
atttgctacaagtacacagtcaatcaaaaatgggggctatgtattaattgtggtttactgatgtaaagatgtggttagaggatcgatataagtcttgcattaaaaataatttagcattgaaataatgacataatattacaaaattcccatatgaaaaatatgcaagaggtagaaaaacaaaagaaaaggaaaccgaatactcaaactgtaagaaagtatcatggactctgctttactcgagaacaaaaattggttgcaacagtatggtatcatgaaagatcttatacaggaatatcttttgaccaactctgccaaaattttcttactcgattccatgtgcaatatccagctattaggaccctacatcgatgggagaaaagactatttaaagaagaaggtgatattgaaaagagaaaaa

SEQ ID NO: 6801 - DNA, 247 bp, Diabrotica virgifera
  Clone ID: LIB150-039-Q1-E1-D11
tgagtcgtattagttgtgtatcgcggtggggatgcacctacgaaggtggacaatacaagagtacctagagactatgatttgggatatggagtactcatattctctaagtgtagaatgttccactcaaatgcattatacaggattcggtgggaagaaagtatacactacgatgaaacctcaaaaggcccagattcttgtaaaaccaattgtgggacataaaaatggccgaactatatttgttttgggc

SEQ ID NO: 6802 - DNA, 405 bp, Diabrotica virgifera
  Clone ID: LIB150-039-Q1-E1-D2
agaaaacggtggaagtcttggttggtaaatgtaacatctgttcactaactcctgttgtttatcacattgttgaaaatagcatacgattgctttcaacagcaatctatgcttgtagcaaacatataatttaagtttattattttagttttctagtgtgccattacttttttccaagatatatagatataacttttatatatattttttagttaataaggttgtttctaggaacttagaattatctgtcaatgaaatttttgatgtcaaattagtcccatcccttctgtcagaagttatttccttaatcgtgtattagtatcctaatattttagaagtatttgatattaaactagttaagatactgcttgaacaatgaatattggaattaatggaaatagaacaata

SEQ ID NO: 6803 - DNA, 416 bp, Diabrotica virgifera
  Clone ID: LIB150-039-Q1-E1-D4
actcaattccaatctaccgttttggaagttatcaacacaagcaggactgaagatgcagtttttaaagctgaaggaggagatgttattgaagatcttgaggatttagttagaaatattgatgaaaaacaagaaactgctcttcctcttattccaacaaatttggagagcttcaatttagcctcacgttcatccgtcactgctttgatgtatgatcctaatgatgttaccctttccaaatctcttaaattcactgttaccaacaacggaaaatctgacatagaagttgaggtgatatacactgacagcgatgaccgtgccaatgatcaatacaacgtagttaaaccaaatgaaactgtaaaaattgagcataagaaagacgctggggtaactcggttaaatgtattgaacagagatta

SEQ ID NO: 6804 - DNA, 416 bp, Diabrotica virgifera
  unsure (1)..(416): unsure at all n locations
  Clone ID: LIB150-039-Q1-E1-D6
aaaaatcctgatcacatgctttaaatttacaatcagtgcgacaaagcccaatttaaccgacatcaaaattaggccgctactgagatgatcaacaatcaagtagtagctactagcacaactctagtagccggagctgcggttctagcttacctcggattccacttttttcaaaagagaaaggctgtgaaaataccgacaaaatgggaagaaataggttcagtatctggactatatttatatccattgaagagtggtcaccgaaaggagctaagtcaagccgaatgtacccgtcttggtttaaaacagactgaagaggatgaaaaagtacttcaattaagagacaggggtttagtagtatacacagaanaagataaagaatttagaacagctagaacatatcctcaactcctacagat

SEQ ID NO: 6805 - DNA, 433 bp, Diabrotica virgifera
  Clone ID: LIB150-039-Q1-E1-D9
gggtcgaggcacgcgtccggttcaacacgttctagttttgtctcgaggagttgattcgttttgttggcagtacattttataattattggagtcggaatatttaattaatgtgattagaaagtgtatagttttagaactagccatcacttacttaaatttctttaatagactcattgttttaatatagtttggtcagttagttaataaagtgtaattaaaaatgagtgaccccacaaatcctactggactacctagaagtttaaattatgaagcattaaaggctcatataatatcgcacaaaataaattgcggcctatggttaattagggtcataggcattctctgctccatagcttacttcattccaatttttggaaatccttacaactactattacaaagtactcctagcaaatgcagctatcagcgcattg

SEQ ID NO: 6806 - DNA, 426 bp, Diabrotica virgifera
  Clone ID: LIB150-039-Q1-E1-E1
acccacgcgtccgctgtttcggggtttttccttgaagtcgccggtttgcgaagtcacgaacttgttcctttcatttgcaccatactgtatacacatgcaacggtggaaggtggtgtctcgcactcgtgattagaaattgaaaagcgaaggagttctgaatgttgtattgcaaaaggactcttcgggatttcatcaatcgatgtttgaagagtgtctacctaccttggcagcattcaaattttgagtttttcacgtggtttttgagggttggaaatggccgatttcgcaatttttcggtttttgatcgcttgtatgtcagaagctatcaactttagagaggagtcactggagaccttttctgtttggaatgatccaagaaacctgaagggactttgttccatgcagaaaaataataagggaaaaacg

SEQ ID NO: 6807 - DNA, 388 bp, Diabrotica virgifera
  Clone ID: LIB150-039-Q1-E1-E11
atccacgtgtagctttctgtgctttctttttgtatttttatgttattctagttcagtcgtaaaaagtcgatcaaatagtggtagtttcattgcaataaagatttattgtgttgttattaaaatattcctaacctttaatttaacgcaacaatatgagtaacgtaaatattgaagatactatttagaaatcaaaaagtagcctatctttttggtcgcctttatacgatagttttaacccccctattaaaaaatcaaggtgcacttggcataaaaatgctagcagggagtcaacacctcatacaacacaagactggaaacgcacgaccaaaattctgcctaacgcactggaagcaattggaaatacccctctcataaaaattaaatagga

SEQ ID NO: 6808 - DNA, 313 bp, Diabrotica virgifera
  Clone ID: LIB150-039-Q1-E1-E2
gctgtttcggggtttttccttgaaatcgccggtttgcgaggtcacgaacgtgttcctttcatttgcaccatactgtatacacatgcaacggtagaaggtggtgtctcgcactcgtgattagaaattgagaagcgaaggagttctgaatgttgtagtgcgaaaggactcttcgggatttcagcagtcgaggtttgaagagtgtctagctacctaagcagcattcaaattttgtatttttcacgtggtttttgagggttggaaatggggcgatttcgcagtttttcgggttttgatcgcttgaatggtcagaagg

SEQ ID NO: 6809 - DNA, 415 bp, Diabrotica virgifera
  Clone ID: LIB150-039-Q1-E1-E4
acgcagaagataccggcatccggtgatattgaaagtggttaaaaaaaaataaataaataaaataatggcttcaaacctgttggtgggccccaagggccttgatggcctttcccctccgaaccaagaccgttaaaagcggctcacctgcagggagtaacagaaaataactcaaaaagaggtacctgtaccttggaagttccaactaatgaactaattcctgcagaagacagacatggcgtaatacctaaaggaaatggatccagaaacggatacagtagaatagatgtgtgctgtagtggatacaaaagagttccaaaacccacttgcaatgtgagcctgtctgtgatcactgcgagaatggtaactgcacgtctcctggtcatttcgaatgcaagcgaggatggattcatgatcg

SEQ ID NO: 6810 - DNA, 256 bp, Diabrotica virgifera
  Clone ID: LIB150-039-Q1-E1-E9
tgagtcgtatgtagtcagatgctcgctggggatgcagcagcgaacgtaggtaatccaagtatacgtagaaactatggtttgggaaatggagtactcaaattctctaggtctaaggtgttccacaagaaaacattatacaaattcgtgtggtaagtaagtagaagctaccaagaaagctcaagagccccaggttattgaaaaatcaattggtggagagaaaaatagaggaaagagatttggtttgggcaacaaacgt

SEQ ID NO: 6811 - DNA, 359 bp, Diabrotica virgifera
  unsure (1)..(359): unsure at all n locations
  Clone ID: LIB150-039-Q1-E1-F10
accacgcgtccgctacatcttagagaagtgagaggggaacggtgcttaccacaaatctataagagcgcgtgggaggangggcaacaggtgtacgatgaaggggggaagggtattccaaattttttacgatattgtttatggatgtttccattttttgtgaacagattaaattcaaaatttattaaaaattgtaaacaatattttaggttaagtatatgacattttatgaaattgactaaaatttgaaacataattttgattgcacacactaacctgtaatttcgatggctttaatcgacccctgcatagaataacgttgtaggtaactaatattgttggcaantcttgatttactgtgt

SEQ ID NO: 6812 - DNA, 287 bp, Diabrotica virgifera
  Clone ID: LIB150-039-Q1-E1-G1
agcacattatatcttcaaaccagtacctttctttacctaggttatcgtctcaagccgttttagaagcgctatgtcccgaagagtttaataaacccagaaagaggctgtgcgttgttttagtaacaacgtcttcttcgtattatctcccttacagacaatcatttatgtattttgcacaacagtcgccttacagtgtcaaaaaagtgaaattggttaacattaattacaacaaacagtcagagttggttaattcttaatggcaaaaaggtgaaataataaagccttaa

SEQ ID NO: 6813 - DNA, 397 bp, Diabrotica virgifera
  Clone ID: LIB150-039-Q1-E1-G12
tccaaccctctaaaattagtcgtattaacccggatacggtcaacaacaaggaaattacccacctgaagcttatcctccaggaacctaccccaactggcgttaaatcctgtgttaaatatggcttcaagtccagcatataccactgcacaacgtgaataacagatcttgtatcgattataaaaaagatagacctcggttatatccaacagaaactataaatactcgatttttggtcgcgactgttatgcattacatttttgtacggacactgtagtagttgttgaaaaagagttttctctcttagtactagtattagaaattggcagtgctggtatacataatatttttaaaggtcttctgattctagaaaagcatttataagttttagtttttatat

SEQ ID NO: 6814 - DNA, 170 bp, Diabrotica virgifera
  Clone ID: LIB150-039-Q1-E1-G2
agtcgtattcaaaccagtacctttctttacctaggttatcgtctcaagccgttttagaatcgctatgtcccgaagagtttagtaagcccagtcagacgctggtggcgttgttgtagggctcagcttcgtcttcgtgaggggggcacgtatacacaatcatttatgtattt

SEQ ID NO: 6815 - DNA, 347 bp, Diabrotica virgifera
  Clone ID: LIB150-039-Q1-E1-G6
agaaaaaaagtaatagaaaaaaagtaataaaaaaaagaaagtattatcaaggaatctacctgccaaatttcaaaattttcggatcaaatttagagtgatttaacaacaaaaaacccattttttgtactattttttacattatttaatttattctgtgcagtgtttattgagatatagttacattttaggaaatatattgataaagtattagcaaggaatctacctgccaaagttcaaaattttcggatcaaatttagagtgatttaacaacaaaaaacccattttttgtactattttttacattagttaatttagtctgtgcagtgtttgttgagatataatcacat

SEQ ID NO: 6816 - DNA, 306 bp, Diabrotica virgifera
  Clone ID: LIB150-039-Q1-E1-G9
cgaacatcagtctcctccactcccgatcctcaagacagaccagctgccgtttgttattacgttacgacagatgttacttttgcgaaccacgcgagacgcagtgcattgcaaacgccagaggtacaagaggggacgattcggtacgttttcatattttaagcacaatttggttgacgtttctgctttggttactttttggggctgtcagtcagttgaatttgttgcagtttttgctgaactttttgcgtgttgcagtttctttagacacaaacagttgtgttcagatttaattttagattgggcatt

SEQ ID NO: 6817 - DNA, 336 bp, Diabrotica virgifera
  Clone ID: LIB150-039-Q1-E1-H11
tgagtcgtattatgaccttcgttttagtttaataacattaatgaacacttcaacgacaataatatttgtcattcatccttatcaaaggttacttccacgtatttaataattggtatgatatttagtgatattgtaaaagtaagaagaaccggtaataattagtattaataattaagaaaatggcaagaataatcatatttggttgcactggaatgaccggcatttgtgctgtataagctgctgtaaagaaaggactaaatgtaaaggccttcgttagacatccagcatgactacccgagcatttaagaaacagtgtttaagttgtcacaggaaatg

SEQ ID NO: 6818 - DNA, 375 bp, Diabrotica virgifera
  Clone ID: LIB150-039-Q1-E1-H12
gaaggaaggtccacaaggccccccaattccggattaatccaccaaaaaaggccaagaaggttaaaagaacgtcaatttccaaaaccaccttgtaaactttggtaaccaaatcagcggccaaaaagaaagaatttgtgaaggccttataaaattaaatgcgccaatattgctttaggtaattgacaatacgccagaattaactggacaagacatttgtggcatatctttacaagactatggttgtaatggatctaaacgacttgaatggagtattgatataccaccaaaaaccaacattaaacaaaatgagacaccagcaactgaaaataaaacatcattcaacatccttcatatctcggatatccactatggatc

SEQ ID NO: 6819 - DNA, 385 bp, Diabrotica virgifera
  Clone ID: LIB150-039-Q1-E1-H3
tccaaaaagacaggatctatggatgaagtaatttgcaaatactgcaaaaaaagccctgaagtcaggaaatgtttaaaaaaattttaatgaagcctcttgaaaccaggcttagacgaaagcaagaaagaaagggtcttaatttcacctatagcatttaaccgaaattagtgaatttgcttgtgcataggatggcgacagacttgcattgtttgttgctgaaggcggaccagactgtattaaatccaagacagagggcatccagaagtgcttaaatcaaactcttcaatttaatccagataatatatcaaaactttccattaaattggcattgataagaagacatgccacgatttggggcaagttcagacctgtgtaattgctgaat

SEQ ID NO: 6820 - DNA, 228 bp, Diabrotica virgifera
  Clone ID: LIB150-039-Q1-E1-H4
gtttgggggtcaggtctcatggctcgggagctcttgtaacaggtcatacttatatatgtactagtttcgaatttcatttacatgcagcattaaattttcaattcaaaaatggagtcgatgatgccacgcatgggacgtcatgcaacactcttgttgtgatatatccgggatttctgattagaggagaagtaccatatttaattaccaagtatattcccaaattaaaat

SEQ ID NO: 6821 - DNA, 423 bp, Diabrotica virgifera
  Clone ID: LIB150-039-Q1-E1-H5
gacgataagtggttaattattttaaataaatatctgcttaaaaaagagctcatttttgtgtttattgtgtatttggtggttggacaagcagtaaaggatgagatcgcttctatttcttctgcttttctatacctggcaaatctctttcgcccaaaagtgttcgagtccggaagtatcaagaaagttatcatttatttatagaacagtaccatcatctcaaattgaagtggtagaatgtttctatactgacggcaactcgaaaaatgattattacgatattaccaaaaactgcgttactgctgccaggaccagaatattcattgataaatatggcgacgatcaccgtgttaatgagggaggatccaaagtttctcttaaaacgtactataccaatgctgatctatcacagaacgtagtttttct

SEQ ID NO: 6822 - DNA, 367 bp, Diabrotica virgifera
  Clone ID: LIB150-039-Q1-E1-H9
gggtcgagcacgcgtccgaccagaaaccgtcaatgggggaaactttttccaataatgggtcggaacaatggggaccaaacaagactttaattccacaaacgaatccaaactggtaagtgccataagacttcccaactaaggtacgaccttaagagaaaaatggaaatacctaactttaagagggtggggaagaacaaggtaatttaatgggtacaaatttttttttacaagcctgggaaaaccaagaaaaggtttttaaggaatttggcccaacatggaacggttcgttaatggcgaaaaccgaaagaccccgaaaaactccaaaaccattaatttaaatagctaacaggggtaaaaaccaaggaaa

SEQ ID NO: 6823 - DNA, 270 bp, Diabrotica virgifera
  Clone ID: LIB150-040-Q1-E1-A1
tacggtcttagattcccgggtcaaccaagccttcgatttaatttaaaataataaaataatttttagtaaaagttaagaaaaaatttaattaaatgaaagttaaataagtaatgtgaagagaataatttaattttaataaaggaaaaattaatttttggtacttgtgtatcagggaatattaattaataaatatatatttattaatttcgaaatttaaagagctaaaaattaaaatttttaatgtaaataaatatttaaataatttttttg

SEQ ID NO: 6824 - DNA, 371 bp, Diabrotica virgifera
  unsure (1)..(371): unsure at all n locations
  Clone ID: LIB150-040-Q1-E1-A2
actcgtccacacatcaatagctatgaagtatctatattatatatatttcttttgcacactttcctgttatgtatcagcagaagacgtcctactaggaactgatctttgtgaatgtaatgaatgcctgaaaccaatccttgaccaacttgggggcagcaacgttacaatccagaagatcgaagctctcatacaaagattaagaaaagatgtcgtaactattacagtaatactcaacgaaacctgtgaaaaaatccaaggtattcaagaagacatcaagaatttagacgctgtcctcgacgataacgttgaactggtcaaccaagagaatctaatcatccacgatatcgatgtcagagttanggagctcggtc

SEQ ID NO: 6825 - DNA, 385 bp, Diabrotica virgifera
  Clone ID: LIB150-040-Q1-E1-A4
gttcagcgaattctcaaagtattttcttctgctccgattttagctaattttttcttgtggtttgcccgagaagtacaggtaagtgggttggacaaagtggcctttcgttaattatatattgggaatgaaaagagaatgaaaattttcaagatacaatatttaaaactagatcatggaagaaaaaggaaacttcaataaatgtatctttcttccagtttctgaaaccgtccgagctacaccgtgtagtgtgccgatagactaacgtagaataaccacaggctgttcctgtggaaaatactggatgttataaagatgtccatatctttaaagcactaaagaattgagctcacaacatatctgggcactattgaagcattgatgaacg

SEQ ID NO: 6826 - DNA, 416 bp, Diabrotica virgifera
  Clone ID: LIB150-040-Q1-E1-A7
atcatattataacaacgaacaaattatgcaatacatttaaattttgttagagtgagaatttgttatttttggaatgagtgttgtttgtacatagaaaatatttagtatatctttttaagtacctatttgtttatcttatagttgtgttagtgtgtactatttaatttgtttgccagtgtacctagagatgttgagatgaattttaatattatttatattcttttcttacgttacagtattcacgattcttttattgtatattttttacttaactttaatgaactgagtatgatcaagattttatacctattttattttatttaaaatttagctttaaagtttccgtctgatcttttaactttttcgtatttttatcagttcacactcagttattactcaatgtagaacaaaatatg

SEQ ID NO: 6827 - DNA, 409 bp, Diabrotica virgifera
  Clone ID: LIB150-040-Q1-E1-A8
gcaaaagactaagttttcaatctaatagcacataaaacaacaccaaaatatgctgttccacatcctaccagactgaaaacaatgggaaccttctctggtaacacctacgaggcttctacaatttgcaagccataacggatgctgagactaaggaagatgagggaatctcatctgagagaaaggtcatgaagaagatatatgtacatgaagaagttgtaagtaaagtaaaactgtaaatattgcagaggctttttgcagtttgagcggcgtaatgccacggttaaattttgttgattaaactacatattatattatacattatatttatattatactacatacccttatctgttcttatagttattgtgcacacattacaattaaatcggtgttataaataatgttaaaa

SEQ ID NO: 6828 - DNA, 377 bp, Diabrotica virgifera
  Clone ID: LIB150-040-Q1-E1-B10
attgataccaaccaaatcttaaacctcatctacaaacaacaacttggacaaggtagtgcttacccactaaaccaatacttggttagccaaagacaagttaatggacaacaaagactcaccgttcctgaacaattcgttaaccaagaagtgttaaatcaagtatacagcgaacaatccttaattaaccagagagcacaacaacttgtagaacagaaccaaccaatttctcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaaca

SEQ ID NO: 6829 - DNA, 395 bp, Diabrotica virgifera
  Clone ID: LIB150-040-Q1-E1-B12
aaccacgcgtccgcccacgcgtccgagaaaacatccattttcttagggccggttattcgagcactaatcagaaatgatcattgtcaagtttttaattgctgtggctagctgtcagtgtcaacttttgtttgggtttctgaaaacataattatggattacaattatgaaattagttaatcaattatgttaataattatgttaattgattaactaatccataattataatcaattatgttttcagcaacccaatcaaggttgacattgacagttggtgacagtaattaagtatttgatggtgatcattgttgattagcgttctaacaaccggccctatgtgtcctacatttatgattagtatatttctttctgcttccgttttttttactgttttta

SEQ ID NO: 6830 - DNA, 318 bp, Diabrotica virgifera
  Clone ID: LIB150-040-Q1-E1-B6
gttttccatctgtcatataaattcaaaccattgtagacataacaagcatgttaattatatgttaatgccgatggatgttggcaaattgatcgagttgttccggtgaaagaactatcaaatttctggaaactagattcgactgttccaagtttaacaatgcaatccacacacctgtcatacataatacgcggaattgctgaagtagaaccctagataatgtatcagttaacatgccaacatagttatacacacaatatatctgacagtcgttatcatccaaacgctctatccatgatatgcccacataagttatgaaaa

SEQ ID NO: 6831 - DNA, 229 bp, Diabrotica virgifera
  Clone ID: LIB150-040-Q1-E1-B9
tgagtcgtattagattattcgatccattaataaatacgaacacagcttgagctactgcgttcatcattgtatacgataataattcaagtaacataattatatagtggggtacataatagtcactggatagtggaatatgaaggtgtaaacacgatgtatactttaaacgaaacccttatggccgaattgtatcatagatttcaacgtcggtacaagatttcatgtattt

SEQ ID NO: 6832 - DNA, 405 bp, Diabrotica virgifera
  unsure (1)..(405): unsure at all n locations
  Clone ID: LIB150-040-Q1-E1-C1
cgtcgatataatanaatatgaaaatggttaacatttcagtaagataaaagtaaagctatttgatgggacaaaaaacaataattaccttcaataatacaaattgccaaaaacaaaacaactgttttgattgtacaaaagggttattcagttctcggtattgatcagtttaataaaatgtattgtaaaaagtattcaaataatatacgaaagtataatacagtgagaaataattacatactaataaacagtcctaatctcatgtacttatctgataaagaaatttattggaagcattttagcgatatagtaaagatgatgattgcaagaaacagagttaatgaaaaatgtgctcgctaacatccattggtggatttgcatctaaagaggaagaaaaataataataat

SEQ ID NO: 6833 - DNA, 403 bp, Diabrotica virgifera
  Clone ID: LIB150-040-Q1-E1-C10
acggtgcggttacatcggccaacagttccatatcaaataggtacatccacttacatctgcccacatgaccataaaacagacagttcagtgttaatctacatttaaagggtgcttcaccatgaaacatatctttatatgggttctatctgcacactgtttagcatctttagctcaaaatgtacctgaaaccagtgaccaaaaagactttctcaaccaaaacatccacggtaccgtcattcaaacagaagtcaattctttaggggatgtccaaggtaaaaactttgaaaattttcccgctaaattcaatgtagatggcagtcaatatcctgaaccgtacaatatagagtataagtaccacaattatgaaaagatgacttcctttcttagacagacgactgcaaga

SEQ ID NO: 6834 - DNA, 377 bp, Diabrotica virgifera
  Clone ID: LIB150-040-Q1-E1-C12
gtgacatacactgacagcgatgaccgtgccaatgatcaatacaaggtagttaaaccaaatgaaactgtagaaattgagcataagaaagacgctggagtagctctgttacatatattgaacagagattacacagaagtagctattatcaccgccaagggtggaagagtagtacgagacattgagagaaaaatcaaacaacttatatctgatgaaaaatcagtaatgttggtaaacaattaccatctagcacctgcatcatccgtagttgtcatgcatcaagttggtagatatagccgaagacccatgtacccagctggacatcgcaaactccaacatgttgtagtgcgtagacttaaacaccatcctggacttacatc

SEQ ID NO: 6835 - DNA, 142 bp, Diabrotica virgifera
  unsure (1)..(142): unsure at all n locations
  Clone ID: LIB150-040-Q1-E1-C4
ttagaaatagagaacaagaattaagttataatcttacgttaaagtanataatanaaacagtaattataataaaacaaatacttatagtaaagaatataaacaaatatgaagtgtcatcaccgcaactgtcaaataaatgtga

SEQ ID NO: 6836 - DNA, 413 bp, Diabrotica virgifera
  Clone ID: LIB150-040-Q1-E1-C7
cccacgcgtccgcaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattt

SEQ ID NO: 6837 - DNA, 379 bp, Diabrotica virgifera
  Clone ID: LIB150-040-Q1-E1-D10
atcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaaataccatatccagtaaaggaaa

SEQ ID NO: 6838 - DNA, 248 bp, Diabrotica virgifera
  unsure (1)..(248): unsure at all n locations
  Clone ID: LIB150-040-Q1-E1-D12
agtgagtcgtattaaacgcncgctggggatgcacgagacgaggtgcacaggggagagaaaggcagagactgcgatttgtgaagtggagtactcatattctctagggggagggatgttccagaggagaagcattatattgggtcgggtggatgagagtagcgaggtgaacgacacgtcataagctcgaggttattgatcgaccaattggtggagagcagaatggaggaggggaatttggtgtgggcatg

SEQ ID NO: 6839 - DNA, 396 bp, Diabrotica virgifera
  Clone ID: LIB150-040-Q1-E1-D5
atagtgagtcgtattacaagtgagagagttaagaacggtttagtgacatcttcaatttaaatttcgaaaaaatgtacagagaagcagtaggttgggcttttaccgcccttttggtctccagttctctagtaggaacattctcttatccaaatgtccaaattaactccaggccagtatcttcagacgcagctgaatcaccgtcagaaccacgtaatttctatccagtgaaaggccccagagacgtgccacaattccagagagcggaaagaaaattcgcagaaaaaccaaatgcaattaaaaaggtggctttggatcgactggatgatgtcgagagtaattccattgcagagagcagcgataacggtcttgccagtggaggaggattctccttggcaa

SEQ ID NO: 6840 - DNA, 403 bp, Diabrotica virgifera
  Clone ID: LIB150-040-Q1-E1-D6
atgcaaaatttcagtgatattgtactcattttttaaataacttatttatacaaattccagttatcttagcaagccgaaccatccaaactgaatttccttaatttaaatgcatgattgtttatgtccatctacaccgactgctgaaagaagaaagccaataactactagttcaaagaatacaagttgttttacaacaagtgataacaactgtaataataattgcagcagatgtgatatattatataactgtaccaattttccagataaatccatatctcattatacaactgcaacgggtgaagattgttcttgtccaaattgtgtctgctcagaaatggaaatacagaatcaaacgtgtgactgggtaacttgtgtttgttcggtttggtttgaaaatgggaaa

SEQ ID NO: 6841 - DNA, 310 bp, Diabrotica virgifera
  Clone ID: LIB150-040-Q1-E1-D7
atagtgagtcgtattaaggcgtccgagcatacacaaagcagggtaaaatacaatttatgccccttaaagcacagacagcgagtataggcgataatcccatggcagtcacagtactgttcagcaccgagatgatacttttcctgctgatgcagttcagctgacgagcactgcgtatgccttgaggtagcaactaaggttgggcaagtattaagtgccaacctgttttgtcaattcaacggtgacctggccgcgtacatagacaacgtgacagcgatatttctagcatacagcgatgagatagttgtggctg

SEQ ID NO: 6842 - DNA, 378 bp, Diabrotica virgifera
  Clone ID: LIB150-040-Q1-E1-D9
agcgggtgtgctaacgtggtgtacaattttcaattgtatttcctacactttctcaagttagttcttttgcagttgcttactgcataatttcaagtaatttattgtgtttgtgcttataaagttcaaataaacatggcaaatagaagaatgggtggcggacctggcggtggccttcggggcaatcgttcttttaatcaaccaccatttcaaggaggtagtggtgttagcccctggcaggggtctaatagttccggtcagggattgatctcccaaattacttccaatccccaacaacttgctcttgctctcacgagcttactacaacctcaacaacagaatccaccatcgttgctttctttgaatacatctcctggttat

SEQ ID NO: 6843 - DNA, 376 bp, Diabrotica virgifera
  Clone ID: LIB150-040-Q1-E1-E10
ctcgtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgaatctggagaaaagaaatcatcctccgagtcctcctcgagcgagaaagaatccagcgaagttaaaat

SEQ ID NO: 6844 - DNA, 243 bp, Diabrotica virgifera
  Clone ID: LIB150-040-Q1-E1-E11
cccacgcgtccgcccacgcgtccggggacatccacaagccaaacaagcgtgaggaactgttgatgcttctagtacctgccaaaactcagcgattctagactaagtcaagaaaaacgatacacttatttatgtaatttatttaattttatagacatcgacagacaaagactttttaccatttgcccagttttctgggttagacttatttattgttattttttaaataaataataaattattttt

SEQ ID NO: 6845 - DNA, 412 bp, Diabrotica virgifera
  Clone ID: LIB150-040-Q1-E1-E12
gtcgcgtgtttcgttgcaagtgtctaaagtgagtcgtattaattctattctattctattctattctattctattctattctattctattctattctattctattctattctattctattctattctattctattctattctattctattctattctattctattctattctattctattctattttattctattctattctattctattttattctattctattctattctattctattctattctattctattctattctattctattctattctattctattctattctattctattctattctattctattctattctattctattctattctattctgttgtagttctgttgtattatattctattgtagatgtaatctaatagttcgggttaaggctttcttatgat

SEQ ID NO: 6846 - DNA, 351 bp, Diabrotica virgifera
  Clone ID: LIB150-040-Q1-E1-E6
acggacgcgtgggtggaaaagccgtgaaatctccaatattttctcccaagggcgactatattttatggcttcaaagaaactcgggtggacctcatgcctctgcgatggaattagttaaggctagtgttcctttgaatgaaaatacagtcagtaaggtagtaattgatattgtggataccgagaaaaaaatagaaggtggtaaattgttttacggtttatacaacacaggattttttagaagaccatgggcgagcaatgaccgactaatacttaatactaaccaaaagtatacaataaattcatatgttgtaaatattaatactggctcattaacacagctggaatataatg

SEQ ID NO: 6847 - DNA, 389 bp, Diabrotica virgifera
  Clone ID: LIB150-040-Q1-E1-F1
tataatttgaaaacgaatatttgacattatatttaacctccaatattatgacagacgtcagtgaccatttacaatcgctccaaatataataatgacgtcatatcgtcgccttagtattataagttgataactccaaaattggcgtttttgagataaattcacagggtgtattttatgtgcctccatattgtgtaaaaacgtgataatcgcctccaaaacgggtcaaattttatttataattgacgaaagttgataaaacgcagatgcccctaacattcagtgctaaaacttgacaagatgagttatcaactacctttacgatacactaaatgctataactagctacctcgagctcgaaaaaatgtctcgaataaaaattacttagtttt

SEQ ID NO: 6848 - DNA, 412 bp, Diabrotica virgifera
  Clone ID: LIB150-040-Q1-E1-F11
aacacatactttttatctagcatcattctcttccacgcatgaaactcatgacaaaccagctgccgtttgttattaagttaaaacacatgttatttttgtgaaccatctagactcagtgcattgaaaagagataggtacaaaaaaagacgattcggtatgttttcatattttaagcacaatttgtttgacgtttctgctttgtttactttttggggctgtcagtcagttgaattttttgcagtttttgttgaatttttgcgttttgaagtttctttatacacaaacagttgttttcacaactaattttatattggacattcaaattttaaggtaggtaattatattttggcaattaatatttaaaacatacaaagataacgtcattcacacagtaaagaagtgattgtgttta

SEQ ID NO: 6849 - DNA, 106 bp, Diabrotica virgifera
  Clone ID: LIB150-040-Q1-E1-F12
ctagcagcattcgcttccaggcatgaagctcatgacggtcgagctgccgtttgttagtaggttaagacacatgtaagttttgtgacccagcgggactcagtgcttt

SEQ ID NO: 6850 - DNA, 385 bp, Diabrotica virgifera
  unsure (1)..(385): unsure at all n locations
  Clone ID: LIB150-040-Q1-E1-F2
agtgcattcgacttcataactataagagcacgaatgtgcacctttattttacgtagtctttgtagagtttttttttgatacctttaagaatagtcttatgatggagtaacaaacatttgcattccagctcaaacaatcgctgtaaaagcacatcggcttctaaatgtatacccatacatatcttcaaatttaacttccctgcgctaagttgtagtccaattagaagagaagcaaggcgaatactcaaatatttataataaaattttattattaatattacttgatttatattatggatttgcttatttctgatctgccgacttttagtgacaattataaatcaactcaaaaagttttcgtacattcncgctcatcttgttcataa

SEQ ID NO: 6851 - DNA, 355 bp, Diabrotica virgifera
  Clone ID: LIB150-040-Q1-E1-F3
agtccaaaccaattcgagatgaagtgttttttgctgttggtgattgtaggaagcttcctaattgtacctctgaacagtaatcctgttagtctttcgcgctcaaagagatcctttagtagccaacccaaaggatactggagcaaaaagttgacatggaaaaccgagtgggtaaaagtttggaagcaagagaaaaagctcaagtgggtttccgagtggaagaagacccaagtacctgcatggaaagaagtccaggtcccaatttggaaggaaatacaagttcccgattggaaagtgatttctaaaccaatatggaaggaaattcaagttccagcatggaaagagatacaagttcctg

SEQ ID NO: 6852 - DNA, 395 bp, Diabrotica virgifera
  Clone ID: LIB150-040-Q1-E1-F4
aatttatattaaaataataaaatattttttagtaaaagtaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttaataatgatgataat

SEQ ID NO: 6853 - DNA, 188 bp, Diabrotica virgifera
  Clone ID: LIB150-040-Q1-E1-F5
tagtgagtcgtattagctgaagatgttcaggtttttcgtactagctactgccttaacaacgatctcagcctcaggatctaagcagcagaggaatgaacccgtagttcgtgaaccgtttccagatggctcttaggtttctgagagtcactgcgatggagggagcgtaggcggacatggacagggacgcg

SEQ ID NO: 6854 - DNA, 350 bp, Diabrotica virgifera
  Clone ID: LIB150-040-Q1-E1-F7
gtcacacatcagtaaaattgtaaatttgtcatggcgctgattgcaatcagtagggataattttgtcacacagctttataggaagttcgaagattacgtacaagtgaacagtgagtaattattttcagtcaggtacatctatcaccaagctcaaactttcgatcagaatgttgacaatcctgaccagtctgagtgacgacgatacaactatctagccaacgcaatgtatatgcccgctctatacttcattaagggctcgaacttgaactggtgctgtcgacttagtgcaaaatcgagtagcctgggagatgtggcattacacgccactgttcgatcatattatgaccgaca

SEQ ID NO: 6855 - DNA, 386 bp, Diabrotica virgifera
  Clone ID: LIB150-040-Q1-E1-G1
cacacgcgtccgctggctttataaagagaaaattcccaatccaaaatccaaattttccaattgactttgacaattaagtcattgtgcgtgaagtattcaggaagtactcgaagtattaaactgtaattacttgatttgtaaactgagaataacgtgttcatttttcaaaatgaatcatttaaagttattattaattctaagtacaattattgtatttaaattatctatggtttatgcaagtaaaaatgatggaactatgagtatcgaacttagacgaaagaaaagccctagacaagagttactggaaaacgaacctacccttagaaaatatggatacagactggaatttcttaaaaacagaagaattaaagaaccccgaacaaacg

SEQ ID NO: 6856 - DNA, 394 bp, Diabrotica virgifera
  Clone ID: LIB150-040-Q1-E1-G10
cttaattaatttatgaaactatttaaatacattctacaaaatccattaataagaagtgttagcgcaactcacattacctcaactacatcaattttgagacgtacagccatggctactccacaatttgaaatactaccctcacccattcagggcgagagtgatgaaaaagaatatagggtaataaaattaaaaaacaatttggtagcttgtttaatatccgacaaagcacctatccccaaagaagagatggagatggaagactctgaaagcgagtcagacaacaaattatcagagtcagaatcggactctgaaggtagtgatagttcttctgaggctggtgaaaccacttccactccagatcagaagatggctgctgctgcactttgtaatggtg

SEQ ID NO: 6857 - DNA, 372 bp, Diabrotica virgifera
  Clone ID: LIB150-040-Q1-E1-G3
ctcgtccacacatcaatagctatgaagtatctatattatgtatatttcttttgcacactttcctgttatgtatcagcagaagacgtcctactaggaactgatctttgtgaatgtaatgaatgcctgaaaccaatccttgaccaacttgggggcagcaacgttacaatccagaagatcgaagctctcatacaaagattaagaaaagatgtcgtaactattacagtaatactcaacggaacctgtgaaaaaatcgaaggtattcaagaagacatcaagaatttagacgctgtcctcgacgttaacgttgaactggtcaaccaagagaatctaatcatccacgatatcgatgtcagagttagggagctcggtctt

SEQ ID NO: 6858 - DNA, 393 bp, Diabrotica virgifera
  Clone ID: LIB150-040-Q1-E1-G8
gggccgacccaagcgtcaaattattaattaataattatatatttattattttcgaatttaaaagagctaaaaaattaaaatttttattgtaaaataaatattttaaataatttttttgtaatgaaatgttattcgtttttaaataaatccaattttttaagaaataaattaaatttaattaataacaatatatttaaaattaaataattttaaaataataataataaataattttaaggatgaacttaaaaataaaattttaataaaatttaatttttaaataaaaattaggattaaaaattttcatattttaaaatatgttaataattatttttatatattagtatttttattttttataaattttttagtaaaatataaatttaaattaat

SEQ ID NO: 6859 - DNA, 398 bp, Diabrotica virgifera
  Clone ID: LIB150-040-Q1-E1-H11
tcgcgggtcgatacacgccatctagtatttgtcgtgacattcgttttagtttaatagcattaataaacacttcaacgacaataatatttgtcattcatccttatcaaaggttacttccacgtatttaataatttgtatgatatttattgatattgtaaaagtaagaagaaccggtaataattattattaataattaagaaaatggcaagaataatcatatttggttgcactggaatgaccggcatttgtgctgtagaagctgctgtaaagaaaggactaaatgtaaaggccttcgttagagatccagcaagactacccgagcatttaagaaacagtgttgaagttgtcacaggaaatgtcctggactacaaatccgtattggatggcataaaaggtgt

SEQ ID NO: 6860 - DNA, 368 bp, Diabrotica virgifera
  Clone ID: LIB150-040-Q1-E1-H12
accacgcgtccggaacggtgcgtccggcacaaggcttttgaagttctgcactcggcgcgagtgattgtggtgattgtttttggttttagtgtgttttcgaaaaggatttaggtaacaatggtcaaaggaaaagtaatacaacttaccgacaacatgtcgaccaaagacagagtaacaatatgcgccgcagaaattggaggaacagccatgctcgtttttttgggttgcatgggctgtgttagctccttggcttccggaggtgtaattccccacgaacaaatttcctttactttcggattagctgtaatggtagcagtccagacttttggacacgtttcaggatcacacattaacccaatagtgactgt

SEQ ID NO: 6861 - DNA, 325 bp, Diabrotica virgifera
  Clone ID: LIB150-040-Q1-E1-H3
cgaagatgaaggtattagttctcttttctttagttgcactcagcgttgctctaccaacactccttggtagaaccgtaagagtcacagaagatggaactgtatctctcttcgactctagaggataccaactcgtaatcctcaagagtgttaccgatcccagacaagtcgaggttgttctcagaagtccaaacacaagaacccatatgttccaagttggggaaccactgagaactggagaagctatcgaccgtcgtaccctcgctggtgtttcagtttaccaaaactacaaccaagctgatattcttactgatatttttcgtcagta

SEQ ID NO: 6862 - DNA, 433 bp, Diabrotica virgifera
  Clone ID: LIB150-040-Q1-E1-H4
caacatgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcctgaacacttatggagctccagcgagcaaattggtacatac

SEQ ID NO: 6863 - DNA, 296 bp, Diabrotica virgifera
  Clone ID: LIB150-040-Q1-E1-H5
aatagtttgtacgcaaatcaacttatccgcgctcgacaaaacgaaacagttcgcgttatcaatatcaacgtggttccaccatattgttagaaaaacctatctcgcgcaaaagaaaattaatttcgggatccagttctgatgctgtgccgttcccatgaccattgtcagttatgttagcatgaacttcagctatcactagacctggaacagggagattgtgttcaattcacaaaaacttgttacaagaccctgaaaaccattggggaatacctccaaagccacccttcacgacgact

SEQ ID NO: 6864 - DNA, 428 bp, Diabrotica virgifera
  unsure (1)..(428): unsure at all n locations
  Clone ID: LIB150-040-Q1-E1-H6
actagcacctgcatcatccgtagttgtcatgcatcaagttggtagatatagccgaagacccatgtacccagctggacatcgcaaactccaacatgttgtagttcgtagacttaaacaccaccctggacatacatcaggacgtcttgcaggtaaaccagcagcaccccgtccttctaaacaatcaggtagcccagcaggttcaggacgtcgtccattccgtcgtccatcttgtaggccaatgatacggccagcccatctttctagtcaaggtggtcaacatccagcacaacaaactcaagaacagcaccgtccagctcaacaacagcaacatcaaagtcctcaagttggacaatgcagaccagcgcgcagaccaagaatcgtcatgcgccctgctgctctacgtaaacccattgctcatgnataataca

SEQ ID NO: 6865 - DNA, 369 bp, Diabrotica virgifera
  Clone ID: LIB150-041-Q1-E1-A10
agggttcgatatttagtcaatctgacggtcaatcgacaacttgtataagagatccttttaaacgtactaactttgctaattctgctattttgagaaaagaccctgatcttagagagtggtctgaaatttatggaaaatcatcaaggacctatgatgacaaagacagaaacagaaaagcgagatatgaagaagaagatcgcaacggaagatatcgttctgggtcaaagcaatctgaaacgatggctgagtcattttcaagacaggagtcgaatatgtatggggttatgacaagccctttgggatatgatcgtgcttctaattcatatggacagaaaccttcacgcgaaatgaatacttttggcgggcaaa

SEQ ID NO: 6866 - DNA, 178 bp, Diabrotica virgifera
  Clone ID: LIB150-041-Q1-E1-A2
tgattcgaatgattcaaatattctccttctcgggttgattccaaggttttatttgtcaacttttgtagtccacattctaccctctaagttcttctctttcgtttctctctctaaatatctctacatagaacattcttttggagtttatgagtatgttgcgtatgtgcaacataaacaa

SEQ ID NO: 6867 - DNA, 67 bp, Diabrotica virgifera
  Clone ID: LIB150-041-Q1-E1-A3
gcgtatgacgctacaagaccctaaagtgagtcgtataccatgcaagttcatactcctccaagagggc

SEQ ID NO: 6868 - DNA, 294 bp, Diabrotica virgifera
  unsure (1)..(294): unsure at all n locations
  Clone ID: LIB150-041-Q1-E1-A4
acgcgtacggttaaggctgtggtttagcgaagtcatgtaaaactcagcctcaattttgtacacgcacggtcaccggtcacttagtttgagtctatagtctacactcagtctacttacttaactatgttgattaacacgtgcgcaataacagtcttcattttaaacgtatttttattgacacatgttcgaacaaacgaaacaaatgatacccaaacgtgtgttcagttgtacgaaaaaggcctanaaacttacttggaaaacagatgggaaggttgtgtaattaaatttgaaaaa

SEQ ID NO: 6869 - DNA, 222 bp, Diabrotica virgifera
  Clone ID: LIB150-041-Q1-E1-A5
gtcactctgtcattcaattcaatggaccgacggtattgaattcagcaagtaccttactgctcgtggatgtgaagtaaactttaacgagatttctgacggcgttaaagaataagagcagcaccctgtcagctttgatttgtatgaattgaccgcagtttctaaagctttggactctgagaagacatacgtctatgacgccttctctatccatcttggtgctgc

SEQ ID NO: 6870 - DNA, 400 bp, Diabrotica virgifera
  Clone ID: LIB150-041-Q1-E1-A9
cgcgtccaatgaagtatgaaacaaataacagcaaacagttgaggttaaatctttaggggctgaaaaattccatttataaattaacattcttatgtaaacacaacactacataatacgacaataaactatgtccgatcacatgccaaaaattgatttaagcaaaatcaaaaagaccgatttagacttcataacagaaatagaaacacgatatcaatagatggtgctgaaactaacaaagcttataatgaccagtttacttactgctgggtttttaactgctggtaatcgtgggatttaagggtattccatgtaagccgtgaaacaagagagtttcctatacgactttgatgaaccggataagaccactcaataatggctgcaaatgtacaacatgtacgtt

SEQ ID NO: 6871 - DNA, 158 bp, Diabrotica virgifera
  Clone ID: LIB150-041-Q1-E1-B3
tttaaaaaattggtcccttccgaacaaaattgtattattaatttaaggttggaaccaaaccggctcaaaacgggttaaaacccagttaaggtaaaattttaaaatccaaccagccttattataataccggcgagacaaattataaactttaacccagc

SEQ ID NO: 6872 - DNA, 444 bp, Diabrotica virgifera
  Clone ID: LIB150-041-Q1-E1-B5
aaacacgcgtccggtgaaaataatgtacttgcgttttgactcaccctgtattcgatataaagaaaattagcaatattaaccatttttataattttgacaatcaacaaaaaaatatggcaccaataaaccatcgctgttgtgctaaaaattatgagggaggatggtggtataaaagttgcttcacaagttgtctgaacggaaagtattcaactgttattgtccctgatgcgataaaatatcacggaattaactggcaaggattccgaacaaaagaatacaacttatccggatcaaggataatgatccgtccaataggaagttaagctaaataataccaacacagtttaccatctttgaaacaaaattaaataaaagtgttacaaggaataattggcataatatattataaatgtatatttaaatatatctaaattagttactatt

SEQ ID NO: 6873 - DNA, 252 bp, Diabrotica virgifera
  Clone ID: LIB150-041-Q1-E1-B7
tgagtcgtattaagttgggggtaataacgtattttttcatcctggtctcgaggtcttttagcttgtgatcgttagttattattgtgagatggtatatcagttttgggggatggagcttagtttttgtacggtgtgtcggggggattatatgttagttcgtacatattgagggcttgcgcagttagcagagcggaaactttagtagttttattgtgatgtagcgtgatttacgttggtttttttggagtggtg

SEQ ID NO: 6874 - DNA, 407 bp, Diabrotica virgifera
  Clone ID: LIB150-041-Q1-E1-C11
actccctaaagtgagtcgtactataacagataaatctatctacgaatctcaatctaagtaagactcatgttaattgtgcaatactagtgatgttttctgtcacacaaagagattttgtatgatctttaccaaatgtaacataatatggtgaactcccaacatgattcaagatagttgatcggaatgctgctttaaaaccgaaggtcatagcgaattgacaaatcgtttcgatcgcatattcagtttcatcgtcaaattaacgtgctgtcagatgtcatattgacgtctctgcaccggtgttgccacatctacaaaatgataattcaaagtacggttgcgcagaaagtttgtacttcgataatagcagctttcatacatctatgtttttaacgaaattgaaacctatt

SEQ ID NO: 6875 - DNA, 369 bp, Diabrotica virgifera
  Clone ID: LIB150-041-Q1-E1-C12
ttccattcagtatacgtatacccatgtgcgtgcagaatatgttaagaggcaatatggaacagatcactacagcttactcaaactttgaattcagtcaaccgcactcgagacaatttaggagtgacactcgagaaagatgtaagatctgaagtgacgtatcaacttgacgaactctgcaaggtggaagatcacctcgacatcttaatagccacatgttaacttatcacagttgttcttcaagcacggatttgtagtctgacacatgtggtaggtgacttggaaaaatgttgcatagatatcgactgtttggcacagatggtctacgaacaggcatgcatcttagctcgcgtgtagaatgttgctctgacg

SEQ ID NO: 6876 - DNA, 460 bp, Diabrotica virgifera
  unsure (1)..(460): unsure at all n locations
  Clone ID: LIB150-041-Q1-E1-C2
caggcctctagatagagccagatcacgtaactacgtatacatcggcagaactatccgattcatcanaacccaattcaaaaaatatcaaaggatactttaaatcttcgtctaaagtttcgtccttattccttgtctgcaatggtagaacaccgccaagataaagtacattccatgttttaaaaaaaaaaatttttccaaaaatctctccttctattaccgaaaaattagtgaaacggaagaaatctggaaccaacactgcagtgcctttcagaacaaatcaatagacgcgacggcggaaacagcgatcgacgccatccgaagggacatcacaatggtggagaaacctggtggaaaagtgtataaggaccgttgcataatgttttagacctagaatctatataaaactatgtaatgaaaccatataccagttaannaaaacagttgaaaacaaaaaagaaac

SEQ ID NO: 6877 - DNA, 418 bp, Diabrotica virgifera
  Clone ID: LIB150-041-Q1-E1-C3
aaacggaggaattcttggttggtaaatgtaacatcggttcacaaaccccggtggtttaccacattgttgaaaatagcatacaattgctttcaacagcaatcctatgcttgtagcaaacatataatttaagtttattattttagttttctagtgtgccattacttttttccaagatatatagatataacttttatatatattttttagttaataaggttgtttctaggaacttagaattagatgtcaatgaaatttttgatgtcaaattagtcccatcccttctgtcagaagttatttccttaatcgtgtattagtatcctaatattttagaagtatttgatattaaactagttaagatactgcttgaacaatgaatattggaattaatggaaatagaacaatatgtaaatttaacctc

SEQ ID NO: 6878 - DNA, 415 bp, Diabrotica virgifera
  Clone ID: LIB150-041-Q1-E1-C4
ccagcgtccgagaagatgaaggtactagttctgttttctttagtccttactcaccgtggccctacaaaaactccttggaaaaaccttaggattcaaaaaaaatggaacggtatctcccttcgactcaaaaggatacaaactcgtaatcctcaagagtgttgccgatccagtcaagtcgaagttgttctcagaagtccaaacacaagaacccagatgttccaagttggggaaccacttagaactggagaagctatcgaccgtcgtaccctcgctggtgtttccgtttaccaaaactacaaccaagctgatattcttactgatattttccgtcagtatgaaggtattcttgacgacaccaaatactacaaccttcttaacagaattcaaatgttagttgaagctggactcatcaacg

SEQ ID NO: 6879 - DNA, 265 bp, Diabrotica virgifera
  Clone ID: LIB150-041-Q1-E1-C6
tgagtcgtattaaatactttttactaaaagtaaagaacgcttgtatttgatgatagttaagtagtagtgtgacagaatatgtgaggtatattcaccaccgatttattatttgtaccttgcgtaccagggattattggttaagatctagatacttattaatttcgtatttcaaagagcgagaccctgaaaattttcagtgtgatctagacagttcaaataattcttttgtgctgcaatgttaatcgattttagagacatcgaattt

SEQ ID NO: 6880 - DNA, 328 bp, Diabrotica virgifera
  Clone ID: LIB150-041-Q1-E1-C7
atgcaagcctctaaagtgagtcgtattactgacttgctaccacatgtaatgaggtactgtattctaagggacattaactgtgcttgtgagagaatatgttagtcatatacaccagtcgtttattattcgagccttgcgttccggggattaatggttcatgacgagtaatttggcactttcgtttctcacagacgacttccctgaagtttttcagtgggttcctgacaggtcagctaactcgtttgtaatgtgccgttcatcgttcttaactatatcgagatgtgcatcaaatgtcatctggtgattcagtaccagctgctttatacat

SEQ ID NO: 6881 - DNA, 407 bp, Diabrotica virgifera
  unsure (1)..(407): unsure at all n locations
  Clone ID: LIB150-041-Q1-E1-C8
accacgcgtccgtatctgtcttgatgccacatttaatgaggttctgttttagagggacaaaaccggtgcgtatgcggttaagtgtccgccagtttctccagtccaggttcattccattaggtcgttctggctgtagagggaacaggtcgggtagtttgacgctgacatttctcataaactatttccctgatttaagtcggctggttcctgacgggtcgtcaaactcgtataattaatgcctttcattcaacttccccacattgtgaggcgcatctacggtcatctggtgatgcgaatccagctgcccgatacaatangggtagaagggtaagcttcatacaactggtagttattctacatgttttatttaacgccgtggtgacttgttgggcgtgcatagatttacc

SEQ ID NO: 6882 - DNA, 372 bp, Diabrotica virgifera
  Clone ID: LIB150-041-Q1-E1-C9
aaggttcataacaatatagtgatagttacggggtttaccccccacagcttcctgtgagtagaccccatctgtactacaccgacctaggattcatccagccatacaagattcagtactacgacaatgctgtagcaaatagacgcgtttcgtccacttcagtactgttcaacactgatcccgctaagccccccaggttagaaatgaactatgcctgtacaaatatctctgataatgtcgacagggacacatataatgtctccggttattccaccaccgtatatggaagctccacggggaaatcccccaatttgtgtccgaagatatacggggatagccttggagcttccaatttagtttaatatattttttagt

SEQ ID NO: 6883 - DNA, 443 bp, Diabrotica virgifera
  Clone ID: LIB150-041-Q1-E1-D1
acccacgcctccgaggacgcgtaggcggacgcgtgggtagttttgcaaaattaaggaaataaaatctagcacttaacttttttgaaaatatgtcacacagaaacttttctatcaaaatattttactatttggacaaatttagatgaagttggtataaatataatcgactaacaattttaagtttaatatgccctactaaaatcgtgacgttatatgaggagatggggcttataagtattcccaaataaacttctgatagtatttaaaagttcaaaacatgggctgcctctccatctgcattcagtatacagtattaaaaactactgttgaagaaaaacaaatattctttttctcatgatcatctttcagtgcgtcacagtttttcgatttctctctaacgcattaaattgtatgtgacagaaaaaaaggcacgtctttgaata

SEQ ID NO: 6884 - DNA, 324 bp, Diabrotica virgifera
  Clone ID: LIB150-041-Q1-E1-D10
ctcgcgtttcgacacacgcctctacacacacgtcctgctaacgcgtccgcatccgctcaacaccgctccatgttcttggcatgtataagtgccttccacgcagctgcaggactggtatcgatatcacacgcggtgccctccgagagtctacgacaccactttaccgtcaccttgcccggaaccgtttacatatggaacgactgatctggcatgatatcggacgtgacatcgcatctgatgacgacatcatgacattatcgcactccgggtcaggctgacatgtgatcacgaaatgcagattgtgacactacatagctaagagtt

SEQ ID NO: 6885 - DNA, 426 bp, Diabrotica virgifera
  Clone ID: LIB150-041-Q1-E1-D12
tacaagcctctatagtgagtcgtactaacgcgtccgcccacgcgtccgaagccgctaagcctttaaaatgtttttctgcattacagcctcacacaaatgttccagatcccatatccagaagaaatcgtgtgagaactaaagaagaaagaaagagtacgctggtaacattaatagaacaacgaaatgaagctaaaggaattgtaaaacgtagatcacttcaagctgctgaaaataggaagttagacgacttgaagagaaaaagtagaccgaaacgtggagatgtttcctctgatttgtggcaagatagtgataaacaggcaattattgaaaagtgggtcgataaaaacgctaagaagcataacttgagaggtgtaagtgtacctgtgaaaaagacgaggtctagtaaattggctacgaatattccag

SEQ ID NO: 6886 - DNA, 356 bp, Diabrotica virgifera
  unsure (1)..(356): unsure at all n locations
  Clone ID: LIB150-041-Q1-E1-D4
tggccacactgtcatccacgctgggagggcatggtcatgaataccgaaaaaagcgagaggctgctgatatggcctaccacgcttggaataagttcaaaacaacctaaattcttttangaaaactattggaatacaaattgttattcgaatgtangatatttttataaaatatctgtgtatttgaatttcatagttttatatatatgataccgtaagttgttacaattgtaacaatggagtatattaattttctgtgttttgtagttagttaatttaatttaatgtatttantgttaatttaatgttttgttattataacatctaaacatcttaactttnactacttcctcttcatc

SEQ ID NO: 6887 - DNA, 426 bp, Diabrotica virgifera
  Clone ID: LIB150-041-Q1-E1-D5
aatgccgggtcatgaaggtgtgcatgggaataaacgaaaagatctcttggcaaaagaaggctcgagagaaacctttgtaggcctataaccttgtggcatcaataaagatactacaaaaatcgaggttcagatgtggcttattataaggaaccattaacagaaatggagagccactcaagagcaaaaccagacttaaaagaataatcaagaatattgataaaaaaaactcacgaataattttatgaacctcaataaacgtgataataacggtcactgaaataatgattggttgttactgtttaagaaaccacctatacaaacaaggtaaggtaaatgaaccattgtgcacaaagtgcgaaatggaagaagagaccatacacatccaatgccattggaattgtgaggcaagaattcactggtcaactg

SEQ ID NO: 6888 - DNA, 433 bp, Diabrotica virgifera
  Clone ID: LIB150-041-Q1-E1-D6
actcgtgggtcgatacaagcctctaaagtgagtcattgacaaatttttagaatcttgattcttccgttgaatattcaatttcgcaaacattgtccaaaatgatatctaaagtgggtaataattgaaatagttaaaatattcgttcaatattgagcaaacttattgcgtttaaatacaaatacattaaaaacaattaggtacccaaaacagttttagcctttttatttcttcctaccctttcgtcaccaatatttttctaccccttttccatctttttctgggtctcctttttcctccgaccttttataactatttttaaagttaatttataacatagacataggcactgttagtttttccatcgcatcggtataataaaaacctgtcattaactgaagtatcattttagtgacacctttacataccaacttta

SEQ ID NO: 6889 - DNA, 331 bp, Diabrotica virgifera
  Clone ID: LIB150-041-Q1-E1-D8
ttacaattccctgatagtgagtcgtattaatatggtgataattagtgggtttacgtcccatagcttcctgtgaaatgagcatatctgtgctatggtgtcgtaggattcgtctatctatagatgatatgaatattatgactatgctgtagtagaaggacgtgtttcgttgacttaaacagtgtttatgtctgaccctgcgatgcctgctaagttaagaatgaactagtctggtactaatgtcacatgataatgttgatagggacttaaagtaggtctcatgttattccactaaagtatatggaagctcaattgggtaatcccccaatttgtg

SEQ ID NO: 6890 - DNA, 436 bp, Diabrotica virgifera
  Clone ID: LIB150-041-Q1-E1-D9
tcgcgggccgacacacgcgtctaacagtatccagtggaaaccaagcatgtttacgtccaaccggagaagcaatttctgccagagaactacgagatcaactattccttgcccgttaatactcctcagcccgatattgctatggagctggccgtcgtggacgagctagtcagaactcgtgtggaagacatgcaatggagcagtagcggaagcagcagtcctggatccccgagcagtagtagcagtagcagcaactttggcgactgctcttctgatccggaatggatgccagagccaattgaacagtacaacgacgaacttcctgttaagtcatcccgcaaaaggaccagaccttactctaaaagcggtaccgaggacaagaaggttcgcaagaaggagcataacaagaacgctgctaccaggtatcgccaaaagaaga

SEQ ID NO: 6891 - DNA, 118 bp, Diabrotica virgifera
  Clone ID: LIB150-041-Q1-E1-E1
atattcgaaaaattccactgactattagaagtgctacacttaaacaattttttcatcaaaactttgtaaatatacttttttttcgacatgaaggtttttgttttaattttttttggta

SEQ ID NO: 6892 - DNA, 236 bp, Diabrotica virgifera
  Clone ID: LIB150-041-Q1-E1-E11
agctgatcgtcatgatggccatcatctggcaatttatgctcgagttgggccgactaggattagttaattagcagtgatcaacctgcagactgtgaggtcattagaacggggttcaagagagtgggagcttcgttatatcagcacttgaacaacatggggtgattgtcaggtcgtaccaacttgagattagtgacgtaggcaagtcaattgcttctctgatccaattggattgggta

SEQ ID NO: 6893 - DNA, 488 bp, Diabrotica virgifera
  unsure (1)..(488): unsure at all n locations
  Clone ID: LIB150-041-Q1-E1-E12
ctccaggggggacacggtgacgggggcctaaaattcctgataatatttanaaagttaatttaanaatgnggcaaatatttctaaggaaagatttctanncatcacaagnnctttgggnntagcagattaatttaaagtacgtgaagtttaaaaaagtgttacaacttaattccctngggtgatgggaatnntggtcctgagaatttcaagcnnggctgtgnncagaaaatcccttccaaactgccaaagcgttgcctaattnngaatgggaaaagttgtagactgttgacacccgttttagggggcccaaganntggaaagtttggggtattccctcaaaagctgctnaattgactcaagtnncaacaaaaacaaaaatcgggtctgaaagggtcctctcaatgacccccgttttggaaaaggacacnagatctttaaatccttgctctcagggaaagaattcaatctttatgccaacgttaggccct

SEQ ID NO: 6894 - DNA, 400 bp, Diabrotica virgifera
  unsure (1)..(400): unsure at all n locations
  Clone ID: LIB150-041-Q1-E1-E5
accacgcgtccgattggccgctgttgttgtagccgaaccaccttctggctacaactacaaccggcccagcgggggtggcggcatctccttcgggggaagcagcctctccttggggggtggactgtccggcggtggtggatacacggctgtatcgtctggtggtcaaactagcgaaggagcttccgtagacccacagcttctcgaacaagtccgtcaaattctgctcaaagaagaacagagctcttccagcggcggtggtcatggtggtggtggtggatacccaggaccatcttcccaatacggtgctccatctcctcaatacggagtacccagctaccaataccgcgtcgttggaatcgatctaganggaatcaaacaagccatccaagttgcccagtac

SEQ ID NO: 6895 - DNA, 382 bp, Diabrotica virgifera
  Clone ID: LIB150-041-Q1-E1-E9
aaagagaccacgttactgtgaaattaataaatatttactttttgaaaaaatcgattgcaccatcttgtcccctagagtctagagtatcaaggtacaccaccagtgttggcggtagatattttagtaggttggttaattcaaacaatgagaaaaattacaacacaccatcgttagaccacaaaattatcaactttgaactgtgctcatttaccgacaaacgaccggacaagtcacccccctccgctcaggccataaataaagaatttggtctttgttcaagttcaaggatagtaaatcacacgttctgagagaaataacgctatttcacgttgcgctgttaccgtatttagttttatctttttctattacatattttttgttt

SEQ ID NO: 6896 - DNA, 127 bp, Diabrotica virgifera
  unsure (1)..(127): unsure at all n locations
  Clone ID: LIB150-041-Q1-E1-F10
tacaattccctatactgacgtcgtattaatancgtccgtcccacgccgtccggaatcaaaaaataatcaattttgaaaaatttacacacaatgtttaaaaatttgtaacactaagcatatatctcac

SEQ ID NO: 6897 - DNA, 382 bp, Diabrotica virgifera
  Clone ID: LIB150-041-Q1-E1-F11
tcgtctgatcaacattaagacatgttcttgagagttttaattggcttccacgcggggggagcactgggatcgatgtcgcaagcggtgccctccgacattcccgaatgccctttagcgtctccttgcccggaaacgtttacttatggaacgattgataaaccacgttattggacaggaaacctcatcttaagacgagatcatgacattagcggagtctgggtcaggctgatatttgataaggaagtggagaaagtgacactaaacagcgaagaattcataatcaaactctcggaggacagtaaaatggtcaaacttcaaagccccgatatgttattgaaagccgataatccaaaacttttggaagtcactgttaactacaaag

SEQ ID NO: 6898 - DNA, 439 bp, Diabrotica virgifera
  Clone ID: LIB150-041-Q1-E1-F5
aaaaaccttgaggtacacacacgatatattttttagtttgatttttttcataagtgaataatcaaactaaaatagcgctttactacaaggcatcctggttttaggccttctcctacttttgctgttaccctttttttaactgaagctaaagaaagcggtggaatggttactggtctctactaattaaagaagaatcaacagccatggacaaaacggtcaaaagcaggggatggcctttaacaggtgctaagtgtaacatcaaaccattactatttgatctcgaggaagcactttctgtagagaacacctacaggcccagtgtattagcaattcaatataacgttaaaccaggagaagttactctcaagtccagggatggtattgtacatcttcttcgtttcctgaagtcttggtttgataccccagaacaagtcttttt

SEQ ID NO: 6899 - DNA, 316 bp, Diabrotica virgifera
  Clone ID: LIB150-041-Q1-E1-F7
cgatgcaagcctctaaaatgagtcatattaaaaattaaaatttttattgtaaagtaaatattttaaataatttttttgtaatgaaatgttattcgtttgtaaagatatctaattttttgagaagtaaattatatgtagttattaacgatagatttgggactaaatatttttatagtatgaatattgaatacttttagggatgagctaaacaatagaattttattaaaatgtaagttttaaataagagttaggattaggaattttcataatttaaaatatgttagtatgtatttttagggagtagtagctggagttt

SEQ ID NO: 6900 - DNA, 247 bp, Diabrotica virgifera
  Clone ID: LIB150-041-Q1-E1-F8
accctgaggtgagtcgtattaaacttgaaaatttttagtgtataataaatattttaaagagtttttttgtgatgagatgttagtcatctgcaaagacatctgattttgtgagaagtagattatgttgagttggtgcgaggatattggggactaaatatttttatcgtatgaatactgcgtacttttagggatgagcttagcagtaaaattttattagacgttcatttttacataagagttacgatta

SEQ ID NO: 6901 - DNA, 78 bp, Diabrotica virgifera
  Clone ID: LIB150-041-Q1-E1-G11
cgacgttgcggtgccggtgtgttcagctgcttactagcatgaggaaatcagtgatgtgttaatatgaactagttttgc

SEQ ID NO: 6902 - DNA, 443 bp, Diabrotica virgifera
  unsure (1)..(443): unsure at all n locations
  Clone ID: LIB150-041-Q1-E1-G3
atcttgtgaaattactggttgggctagacgcgaagccagcagaggcaggaactaccactaccagaccaacttcttcccacatcaagaaaaactccttcccaaaaaacaggaaccattacctgccagcagcgattcctcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcaaagagccaattaaggaagaagtgaggccaatcgatccacttcctgttttgaaaccatctgaaccagctcaaccagatgtnttaccagaagaacctaaactaatagatcccgtagtgccccaaattgctgctaaagcgatcccagccgaaccagaagagaaacctctagctc

SEQ ID NO: 6903 - DNA, 96 bp, Diabrotica virgifera
  Clone ID: LIB150-041-Q1-E1-G4
gtcaggattaagtttaaatttttaatggtaaattaaagattttaaaaaattttttggtaagaaattgtaagccgttcttaaaaacttcaacttcat

SEQ ID NO: 6904 - DNA, 453 bp, Diabrotica virgifera
  Clone ID: LIB150-041-Q1-E1-G8
tcgtgggtcgatacaagcgtctacactgacgttctgggattatatatgttatgttatggttatgagagtatagactgtaagcaaattataaaagattacaaaagttattaagagaagtaagtcatttggctcagtgctataactcttgataagctttaattatgtttgagtaaagctattaagaaaatagttagaaatactctggaaacagacttagttgtagaaattccaatatttcatgtaggtatcttacgcatatatgaaatacttaattgtcatattgtgagtgactaacatagcagaatgttggtataagttaattgttacaaatattatttcggaccctaatattaataattagatattttatgtttattcatttttaaagctagtattcgctaaccgttttctgacaaaatgcacgtgtatctttagattgtcagagaatgaaat

SEQ ID NO: 6905 - DNA, 412 bp, Diabrotica virgifera
  unsure (1)..(412): unsure at all n locations
  Clone ID: LIB150-041-Q1-E1-H1
tctcaacagctcaacatgaacgcaatgattgctctcacttntgccgctatggtagcaaccgcttccgcatcccaccttggtctaggttggggattgggacatgccggtatcgtcaacccacacgccctcagcccaattggaccctctggaatcgtcactggagccggcgcagctggtccctctggagtcgtaactggagctggcgctgtaggacccgctggagtagtcaacggacatggagctgtaggaccaactggtcccaacggacatggtgctatccttgctggtcccggagccttaggtttgggattgggtgttgctggtcatgctcttagcccagtaggtcnctctggaatcgtcaccggtgctggagcagctggtccctctggagtcgtaactggagctggcgctg

SEQ ID NO: 6906 - DNA, 366 bp, Diabrotica virgifera
  Clone ID: LIB150-041-Q1-E1-H12
acgtccgcggctgtatatccagtttttaggaagctgtcactcaaccgtaagtgaaattctggatgaagaacagttgttcgacaagctgggggttctgctgactgacagcagctgtgcatttttcagaccatcagtgttagccttcacacttttgagatttgaagttgacaagcaactatctcatactattaacagaacagcaagttttggtgacgtcatccatacattacctgtgatgaaggagttacaactgagatgtgagacatcagctgctgacttggttagttgttcccaattcgcatccaaagtgttaaaacgctacaacaaccatgaaccctgcggaaacaatgcgtacctgaaatggaa

SEQ ID NO: 6907 - DNA, 412 bp, Diabrotica virgifera
  unsure (1)..(412): unsure at all n locations
  Clone ID: LIB150-041-Q1-E1-H2
agcctctaaagtcactcatgataaatacganaatactcattttggcatttttcgaggcttggaaactcaataaattattatttttgaggttaccaaatgcttaactttgagtttaaacattcagtttaaagtttctaaagagtaatggcgacagtagctggtaggaaaatctccagtttaagatttgctgatggcactacacttatagcaataaatgagcaagaaatgtttgatctcctgcgaagagttgagtacgaaagcaataaagttgggctgaaaatcaataaagctgagacaaaataatggtggtcgacatattccacactattaaactgactaaaatgttacaggaataccagatagtggacggctttgtctatctcgggtctagtataactaacgatcgtaactg

SEQ ID NO: 6908 - DNA, 354 bp, Diabrotica virgifera
  Clone ID: LIB150-041-Q1-E1-H6
actccctgatagtgagtcgtattaagcttgccttagtcgaatatcttgttttattgacactgtctattaacttaataattgatacgattttagctttaattatgatccagcatatgttaaagctaaccgaccgcatttggggttcaattgaaattgatatggtatttattttcctctttcgacccgacatcgagttttaggttaccaatacactgattaggatcagtattaggtctatgatctagtccatctagattgtgattaatcccctctcgttgtcattagttatgactacagatgattagaacattagatcgcgactttcaggttttagttggtaagtataaatctcca

SEQ ID NO: 6909 - DNA, 439 bp, Diabrotica virgifera
  unsure (1)..(439): unsure at all n locations
  Clone ID: LIB150-041-Q1-E1-H7
aggaagactaccacaaagctggaatctgggagttaggaaagcgattagcgctcgaaatctaaatgaagacctaactcaggacagaatacagtggcgtttgggagtcggacaacgtcgtaagtcgttatgaaaccgaatatatgtatactaaaatagctatcgcccacattgacggtgtacctgcaatacttgagtggacgtattccatcgaaaaaaaactataatgtggcaatccccagagaagannaaacgaggaagacccacacagagctggaatctgggagttaggaaagcgattagcgctcgaaatctaaatgaagacctaactcaggacagaatacagtggcgtttgggagtcggacaacgtcgtaagtcgttatganaccgaatatatgtatactaaaatagctatcgcccacattgacgggtgtactgcaat

SEQ ID NO: 6910 - DNA, 394 bp, Diabrotica virgifera
  Clone ID: LIB150-041-Q1-E1-H9
tatggtgattctcactaatttttaaaggttgacgaatcgttcgggaaattgtccatcagtaaggttttgccgattaattacttaatctaaacaatttttcaatatggccgataaagcagaagaactattcaagaagatgaggactttcattaaaattcacttttcgtggactggatttagatcaacttttggacatgccaaatgattcaactcatggaactcatgcatctgccgtgccagaacgcgttttacaaggggattgaaacgtaaaccaatggcacctactgaagaaactacgtaaagcagagaaagaagctcctccacgataaaaaccagaagtcgttatgacccatttgacaaacatgatcattgttccagaaaaggctggttctat

SEQ ID NO: 6911 - DNA, 371 bp, Diabrotica virgifera
  Clone ID: LIB150-042-Q1-E1-A1
tcgcgggtcgacacaagcctctaaagtcactcgtggtaaaacaaaatgttcgggattttcgttttcgccattttttctgtcgctgttgcttcagctggtgtacctaaacatcagcacgtgaaagtcgtagttcccgaacaacaagcccaatcctcgcatactctggaaattgccgaaagctatgaaagtggtggctatgcgcctggtgaattggaggcccacgcggcagccgaagcgggagccggtggaagtggaaaaggcagttcaggagcagaattgacaagtttggctcataattcggcagtgcaggctaaaaatgcggtcaggaatcaacatacagccggaagtcaagccgctttcggtgtcaaaag

SEQ ID NO: 6912 - DNA, 413 bp, Diabrotica virgifera
  Clone ID: LIB150-042-Q1-E1-A12
acaggcctctataatgagtaatattaagactcgagactgagacattctttgttcgaatcttcaagagtatttttaaaattatttgtgtgtattgtctttgtgtcttttaaaaagtatttcttcgtgtcttcgaaactttaaaataatggaaatggataaagcaactgaagtccgttgtcaagagaaaaccaaaggaggtcttcgctatgaagtgatccttggtgagccagatgtcaaagctcccccaccaaagttgtcactctctccgaagggcagcatgtccgtccaggatattgaagataaactaaaggcagctgaggaacgcagacagcaattggaatcaaacaaaatggctgcttggtctgcgaaaatcatgaaaatcgaagacgccagtcgcaaaaagaacgaaaaga

SEQ ID NO: 6913 - DNA, 113 bp, Diabrotica virgifera
  unsure (1)..(113): unsure at all n locations
  Clone ID: LIB150-042-Q1-E1-A4
aanattgtacctcaaatactgcacaaaaataaagatatattaaaaaaatgtgggcgagaagtgtatgtgctgtactttatctattttttgtactgtacgaagtaaattcctta

SEQ ID NO: 6914 - DNA, 431 bp, Diabrotica virgifera
  Clone ID: LIB150-042-Q1-E1-A6
accacgcgtccggttctatcttgtttgattttttccgaagtctatttcctattgactcccctatcgctgggttatgttggttcgtaaatttagttgcgaaattagacagcgaatcttggaatagaagtaacatttgcattatatttatttgtttttcagatcgaatactatgcatactagggcggtccagtaagtacttagccttcaaaagtaaaacgaacattttggaatagtggcgatttatttctgaacctagtctcttattcgctcgattcctttgactcagcgatacctcatcttctttaacccaactgaaaaatacgttttctcgaggtttgcaaattaggcttccgtggcggtgatggggcgatgaactctttattcgactaaattttctgcccagcgagtgactttcaagtttgggaacaaat

SEQ ID NO: 6915 - DNA, 290 bp, Diabrotica virgifera
  Clone ID: LIB150-042-Q1-E1-A7
acacgtccggtactatcttgtttgattttttccgaagtctatttcctattgactcccctaacgctgggttatgttggttcgtaaatttagttgcgaaattagacagcgaatcttggaatagaagtaacatttgcattatatttatttgtttttcagatcgaatactatgcatactacggcggtccagatagtacttatctttcagtcaatagaaccaacattttggaatagtggcgatttaattctgaacctaatcccttattcgctcgattcctttgaatcagcgatac

SEQ ID NO: 6916 - DNA, 282 bp, Diabrotica virgifera
  Clone ID: LIB150-042-Q1-E1-B1
acgcgtccaaggacacgtgggttagattctgcagtctgccttcttgtcgaagttggaccatgttgggtgctgtggcaagagcaacttccagccttttggctggaaaatccatcgaaaaagttggttccgaatcccttaaaattgtctcttcatacaatgttcaaaaaagagacttcgctgccaaggctgctgccggtaaggcacaaggaaaagttgtagcggtcattggtgccgtcgttgacgtacaattcgatgaagaaactaccccaattctaaatgcat

SEQ ID NO: 6917 - DNA, 394 bp, Diabrotica virgifera
  Clone ID: LIB150-042-Q1-E1-B11
tcgcaggcctccaaaaaaagtacaaaacatcctgtcgaaagagtgttcagaacacgtattcattgctttaaaagcactacttgatgaaatttcaaatccagatccacaaaagcaattatctcccgctatgtctatagtacttcaactaatagatgaggcaactatacctaatgctgtaaagtacatattaaactgtggctatccagaacaacatcttgaaaaagctttcttcaccttgtccatctggttgacgcaatgtttttgggtagaaaatttaggccctcttgttcttgctttcatgaagggactagaagcagagcaccactatgaaattctaattgaagttactctggtgactatagaacctctttttaaattagtcatgtttcccaag

SEQ ID NO: 6918 - DNA, 242 bp, Diabrotica virgifera
  Clone ID: LIB150-042-Q1-E1-B12
ctgtatggctatgccaatgccaacagaaccagaagtcacgtggtttggatttggattgcctaaatacatattatacacgcgcagcaaatttgaaaatgaatgcaaattgaatagtaaatggcttctcttaaaatataggacattggtagtatgttcatagaatgtcttgtggtaacattccacgaataacttaatcagatattcaccgaatgttccttgaatgtccagtacattcaaacatt

SEQ ID NO: 6919 - DNA, 440 bp, Diabrotica virgifera
  unsure (1)..(440): unsure at all n locations
  Clone ID: LIB150-042-Q1-E1-B2
aatcaatggagactcatcaatgaattaaaaaagtatttttcaaaattaacaatggataaaaaatttgaaacggaacaaaacaaaaaattggcacatttccggcaaaaaattgttcctaaaacgtaaggggaagggtcttgtgaaataatttacatcacagtcaacagacatagtaaaaaatacaccaatgcatgaaactaaagtagaaaaagatgtaaaacaggagcaaagtataccaagtcgtctatctttacctatacaaaatgttctaagtggcttaagtataaatattaagagtaaggaagatgaaaagaaagaaattatacccagatggaaaactgtaacaaaacccattgtatcacaggaagcaatangagccagaactagtcaaattttagtaccgataagttagctgataatgaaactatgaaaattcgaag

SEQ ID NO: 6920 - DNA, 411 bp, Diabrotica virgifera
  Clone ID: LIB150-042-Q1-E1-B3
aaatatttggttttacatttggaagtgtatttctcgagatattagaccgtctccataatttgcctatggtagcagggtaaatagttttttccgattatagcgccatctatccgcagttgaaaaaagtgtctggaataaaagttacctacatttacgtaaggaaatttaatctcggaaaaaaaccgggggggtccacatataatattacagttatcatatctccccccccccaaatctctaaggggtgaattatataaatgacagtagtaacttttttatacctatttactgaacaaaaagtttatattgtaattttactacaatactaatattttattgacaccctttgttttaagaagtgcagctactgtcctaggcatgccatctactcgtatatcgtgctgctatttc

SEQ ID NO: 6921 - DNA, 344 bp, Diabrotica virgifera
  Clone ID: LIB150-042-Q1-E1-B5
cgcatccatcgacactaatacgagcagtacctgagaatacctttctacggagatattcaactaatagttgtaaatacagcttgtacaacatttttaatactggagtctgctactgagatggaaattagtgccagtgatattcgtgtgcgactcagcctgcgcgaaagtgaatgtgtaagagaaaaacattcggaaacgcatgcaactgccaaaactgtactctcgggaagaggtacctcgtttcatatccgatactgctatacagtcaggtgctcgacgacgatcatctacaaagacaagacagaactctacttgtagtgataatggttcttcagaagaatatt

SEQ ID NO: 6922 - DNA, 414 bp, Diabrotica virgifera
  Clone ID: LIB150-042-Q1-E1-B6
agtcggctacagaaattacaggttagattaggtttgggttgggagttttctttgatttgttcgtgtgttgtgcctaaaaacttcagtacaatgtcggctaccagactggagaacggtgcgggtgattatattcaaacagaattgatatcgggcatcgatttcgttaataaaaacaattctaaaggacattgcgccaatggagaaactgggttaaatgaacacactaaatacaagaatggatttaaaaagtcggtcatttccaatggacatgtcacatcatcagacgaagaaacgacaaaaaataggacaaaaaatggttacaaaacagacacatcaacagacgaaccaaaaatccgacaaatcaaagaatccttcgaaccgcctacgttgatcaccaaagcactcaaccacatc

SEQ ID NO: 6923 - DNA, 199 bp, Diabrotica virgifera
  Clone ID: LIB150-042-Q1-E1-B7
atccaccaagcctccggcgaagcctggggtttaaaataagaaaagaatttttaattaaagttaagaaaaattttaattaaagaaaattaattaataatggggaaaaaaaatttaattttaaaaaagaaaaatttaatttttggaccttgggtaacagggaatattaattaaaaattaaaattttaaaaatttccaattt

SEQ ID NO: 6924 - DNA, 144 bp, Diabrotica virgifera
  Clone ID: LIB150-042-Q1-E1-B8
acaacctgcctcctacgatacaggggattttaagtttgcgtagggattttactttgagttgttaatagtgttaagccaagaaacttcaatagtaattctgcaaaagtactggggattagtgcgggtgagtttaatctttggggg

SEQ ID NO: 6925 - DNA, 401 bp, Diabrotica virgifera
  Clone ID: LIB150-042-Q1-E1-C12
atacaggcctctaaagtgaggcattgaaacacgttgacaagaaagtgacgtttcggtgtgttgaaatttgaaagtgaaaacaaataattgattcaaaatgggttttaatatgccaattggtaaaaacgattgggatatctacaaagccaatcgttctcgaagagtttccgaatgcgcgaaccctacatcatgccgttcgagaaaagtgtcagagtggaaatcagaaggtccaagtctgtcgacttctcctggatcggaattcgtaacatccccgatccgcagttctgtgcccagcaatatgtcatcgagacagtactccagagcaagttccagaacaagtgaaaccagccttcccagcccagtgaggcatatgagtgtagggtcatcgcccccgaagaacg

SEQ ID NO: 6926 - DNA, 447 bp, Diabrotica virgifera
  Clone ID: LIB150-042-Q1-E1-C4
caagcgtccgaccaagcctccggcgaacccttggtgggtaagaaaattaaaaacggtagcaaattaataaaaatttccaaagttaataaaagaagttagtccattgggccaatggcaaaaatcctggaaaaccttaaataaggttggattaaagcaataattaaaaaattaagaaatacccgggaaacaaacttagttgttataattccaaatatttcatggtaggtatcttacgcatatatgaaatacttaattgtcatattgtgagtgactaacatagcagaatgttggtataagttaattgttacaaatattatttcggaccctaatattaataattagatattttatgtttaatcatttttaaagctagtattcgctaaacgttttctgacaaaatgcacgtgtacctttatattgtcagagaatgaaatcaagttagttgtt

SEQ ID NO: 6927 - DNA, 106 bp, Diabrotica virgifera
  Clone ID: LIB150-042-Q1-E1-C7
accacccacgcgtccgcccacgcgtccggtagtatcacaagtataaattttaagtaagcttgagacaaaaacagaacaaataaaagggcgtacaaaacacaacact

SEQ ID NO: 6928 - DNA, 325 bp, Diabrotica virgifera
  Clone ID: LIB150-042-Q1-E1-C9
acggtttctagagattacaacatgacaatgaatctacgcattggaggtgtaagtttacttgataaaattgtattcaatactgatcttcatagtggtggtacagactcagtttcatcgattacatttcgtttataaggtcgcacaaatccgtgtgttacagcattgccactccagaagaacgcaaatcagatttatcaattgagtcatacatatattgttcgtcggaagcgaactatgaaacatggatttccacacatttaagagtcatcgagataatcgaccccagaatataaaaagtgacgtcacaatcgggttaatttcttcc

SEQ ID NO: 6929 - DNA, 287 bp, Diabrotica virgifera
  Clone ID: LIB150-042-Q1-E1-D1
cgacccaagcctctagaaagagtcgtattatattttgagttcaataattttttttgcgtcaattagtttaagtagacttttactttctgatcaccctgtacaaatcatgatgttgaagtctatgttactgaagagggagttgaggagacttgcaaatgagctgacacatctctaatacggacgcgatcctcatgaggcccctcaggggcgtcggaagttctatgcatttactaacgatctgcaccattacgtgcggtctcttgcacactatctcagtcgatgatgtg

SEQ ID NO: 6930 - DNA, 415 bp, Diabrotica virgifera
  Clone ID: LIB150-042-Q1-E1-D11
aatcaaatacatcaaatcttctttttaaaaatccctcagatcttatcgaatcaagtcaaacgcatcctatatagagtgttatattaggaaggtggcagtttttgccacttggccaagttttcgcaagctgtaaattttcggcactttgtggcataatagtacaatttttatgtaaaaaactagttttggcaaacaactcatacagataaacatacaaggcgtatatttatacactctcagtttagatttgttttacaagaaagaaaccttttgaaatttcaagggttgcaatttagaaaattttcattttttaatattcgaactgcgaatgaggtaatttgtggccctaaatttttacctatttaattgttagacataatttaaatatgtgggtcccaaaagctcgttccttaat

SEQ ID NO: 6931 - DNA, 374 bp, Diabrotica virgifera
  Clone ID: LIB150-042-Q1-E1-D12
cgcgtccgacctggtggaaaacaattaagccggaagcaattgggtaattaatccaagaaacgaagcctttcaactcccaaattttggagaaataaacgaattgcctgaaaatttgagaataagtagtggaaggtccaaggattaaaatctatatgatgccggaaagcgcttttgccgtggcggccacccccatggtggaggcgcctttcggcatcaaatatattttgatccttggatcttggactatccactgcctattctcaaattttcaagtttgtaaaatcgatctattctgtaaaaattgcgaggttttgtcctattacttggactaattactagcttcattacttggactaattgtacatattccatat

SEQ ID NO: 6932 - DNA, 251 bp, Diabrotica virgifera
  unsure (1)..(251): unsure at all n locations
  Clone ID: LIB150-042-Q1-E1-D2
gtgttgagggggtcaaacttgagtttaagagctttaattggtttgttcctcccgtcgtgtaccttttgatnttgggtttgaaaacnnaagaagaagaaagaacaaacaatcaaattaatatgttacgcagagttttcaattatggacaactggtgaagaccttatcccaagaatatcttaactttattaaggggagtagtagactctgaagatttacctctaaacatttcaagagaaatgttgcaacaaaa

SEQ ID NO: 6933 - DNA, 438 bp, Diabrotica virgifera
  Clone ID: LIB150-042-Q1-E1-D3
accacgcgtccgcccacgcgtccggcgaaaggtaaaagagctaatagacacaatacaaaacttcttaacgcgggtgaaactggtattgcttcgcaaaagtaaagcaaatgtgcaaaaagaaaaatcgttgttaatattttaaacatagtggattaaaatgttgttagttctgtttttgtgtatagcaagattagcaagtaatatatactcacctgtactagctcaaaacgattgtgggcgtttgtgtcagtggtttccaggtctttttaaagtaaaacctgtagtggaatcagctactgaagctgtgcaattccaaaatactcgcccaagtagaccaaataatgaaattgatcaatccaataatgtacagttccaacagcctcgtccaaatagaccaagtgttgaaagtcaacgacccgacaatgtacaattccaaca

SEQ ID NO: 6934 - DNA, 237 bp, Diabrotica virgifera
  Clone ID: LIB150-042-Q1-E1-D5
acaactcactatagtgagtcgtattatgacgtcacgatttgtgatcgattttctgtaacggacgtcagtttctaaattccagtgatccttcatatcaggcttcacgataaggcattaagatcggacgcttacacgttacgcgtgtagcttgagtgttgacagataattgtctcattaaggttgcagatctacagatatatctccatattcacctggggccctatcactgatatactt

SEQ ID NO: 6935 - DNA, 361 bp, Diabrotica virgifera
  Clone ID: LIB150-042-Q1-E1-D6
acacattcatccacttacacgtcacgaaagttactcaaatttcagtacctgccatgaatgatgcatccaacacccccatcatgccaagtatcagaaaaggcatttatgtggccgcttaagatattcacgtgacatctgatcatcactccatgcatgcctcataaagcttcaacatctccagaaatttctataccttcacaatgggtcccttcaatgatctactctgcaacatgattaccgataccggtgcctgaatcaatatatccacagtatacgacgacaacgatgacctcttcattgcaggagataaaggatgtcacatggctgcatttcacaggacaatgatgtgtactgcatcgat

SEQ ID NO: 6936 - DNA, 348 bp, Diabrotica virgifera
  Clone ID: LIB150-042-Q1-E1-D7
tatagtgagtcttagcactacaataccatgagggtcgacattgctagaataatgtctggtgcaacattcgaatatccaggacatccagctttcagagaagcagaagaatcacagaatgaaagcttaatagattgctggagtgtggagataaaattctttgagtaatattccttgtagagaattagatacgcagtaacgacaatcgccttatcaacaatgtattttttttgatagaccagatgagagaaggtctgtcagatggtctacagtaagttgggaggattaagttatctacgatctgcgtaaaatgggaaggacatagtgggaaatacactagtgtaacgtcat

SEQ ID NO: 6937 - DNA, 317 bp, Diabrotica virgifera
  Clone ID: LIB150-042-Q1-E1-D8
agtgagtcgtattaagacaatacgatgagggtcgaaattgctagaataatgtctggtgcaacattcgaatatccaggacatccagctttcagagaagcataagaatcagagaatgaaagcataataaattgctggtgtgtggagataaaattctttgagtagtattccttgtagagaattatatatacagtaactacaatcgccttatcaacaatgttttttttttgatagacgatattagagaaggtctgtcggatggtctacagtaagttgggaggattaagttatatacgatgtgcgtaaaatgggaagtacac

SEQ ID NO: 6938 - DNA, 413 bp, Diabrotica virgifera
  Clone ID: LIB150-042-Q1-E1-D9
agagagaatctagaaaagcagaagcatacaaatgctttattaaaaatgacacagacgattcaatcgtaggaatatctgtaaccgctgaatgtaacacactaatcagtccaaaagagagtccagaagtactatatttaagtgctgtaaagcaaaatccaataaatgagggaagtttacatcctgcctctataggtggagactggatagacagtgtcaacatcgatgcaaaagtctttataaaccaaactcatattgcagaaactgataatattaacggtaaactattaacaactgattatatttgccaagaacaaaggaataatatcgttgtgatggcaaggtattctgtgaccgggtgtccaaatgactatgtatgttttgaatttataaaaaatgatgacaacattattaaa

SEQ ID NO: 6939 - DNA, 394 bp, Diabrotica virgifera
  Clone ID: LIB150-042-Q1-E1-E11
aaaaattagatgccgccgtcaatcttcaggttgttaaacttaaaatatttgttgaatgttttgtgtctatttgattaaaattattatgatactcaaatatttttattaatttttattttatcaaaagtgcagcgattgttatcttcgttatttctgttcaggaccaataaagaattttacagaaaacttaaccttaaaaaattagacgctgtcaaacaagaattaggaaaagatttgattatatttggaagaaaatggttatttcatagcacataaacatcaacaagtataatgtggcctttgctacttgatatgactaaagaagaatcggtccaaaacttaagaaacttggaacttgaagcatactcccagcttgtttctgctttaagagcac

SEQ ID NO: 6940 - DNA, 338 bp, Diabrotica virgifera
  Clone ID: LIB150-042-Q1-E1-E4
gggtgagtttgatcaacgtgtatacttgactggctagagagaagaaacgaagagcattactgtatttaaacatccatttagatgtaagcttgtattggagaacaagcctatagagcaggtcaaccaatgcaaatacctcggtgtaggtttacccaattaccatgacccagttagaggcccaagactgcagatgaataaggccgcagtcagatctggatgtttaagagatattgtctggaataacccatatgtgcgaacggacagcaaagttaaaatttatacgatttgtatccgggccgtaatgacttatgggttataatcaacaatcagattaaaag

SEQ ID NO: 6941 - DNA, 237 bp, Diabrotica virgifera
  Clone ID: LIB150-042-Q1-E1-E5
atacaactcactatagtgagtcgtattatgacgatacgatttgtgatcgaattacttgaggaaattcagatgctgaatacatggctcgttcaaaacaggctgtacgtaaagcattatgacggaaggctccgcgtgtcgagtatcacagtgagtcgttgacacaaaattgtctcagtcagcttgaagagcgacaaaaagatctcgatactctcatggggcactatcactgatatactt

SEQ ID NO: 6942 - DNA, 417 bp, Diabrotica virgifera
  Clone ID: LIB150-042-Q1-E1-E7
atacaagccactacagatgacgtcgtacgtaacgcgtggggcgtggaaggattttatataaaaggtctagaaaaactacaagaagattcaaacttggttgaatctataaagcgttggaaaacaattcttggagaacatagagttcttatagtaagcgatacttttatctcttccttgaaaccacctgcgttaaactttattctagataaggttgatttggttgatatcaggctagatgtaaagcaaggagttaattccgtaagtagacaaatcaaatctttgcaaaataatacattatattcgaaacctggaatgccatggatacattggtcagtaggggatgttaattcccaacgtttagctaatattttaccttccgggaactgtaccctacggggtaccctcctccaactaatg

SEQ ID NO: 6943 - DNA, 418 bp, Diabrotica virgifera
  Clone ID: LIB150-042-Q1-E1-E8
acaacacactatagtgacgtcgtattacaaccggccctaagagttgccggttgccggaaaaaaaaaattcagcataattctatactcgaaaatttttgatttttttattttgacgtggtagaaggaactagccacagttttaaggaaaactagtcactaatgaactataaaacagctcaaaagtcataatctacagaaattatgttttacattgttccccagtttaataatttcttattaaaacttcctcggggtacagatgattctattgtatatacgtgttagagttttattaacgtaattatttgtactctcatatgagtaatgcaagttaaaaataacatgaatttcaccttacattgttgtatttttttctgtattatttatcccaactaattgttctcaaggattgttgtat

SEQ ID NO: 6944 - DNA, 412 bp, Diabrotica virgifera
  Clone ID: LIB150-042-Q1-E1-F10
gacccaggcgtccatgaaaatatctgaatagacagattctttaagagaacaagaagtaattttccaataaaacggacacatttcattgtttttctttcattaaataaaagttgtaaacggtgtttcattcttcatcatcaattgacaatcaatcttgagcctcaatcttcatgagtgtgttttcccagacgttacaccgtccttctactttagccttgacttttccatactcattttctcatggcaaagattccattgtatatatattcatgtttcgttactgcaatatacagtcaggtgcaaaaacattgatccacgcctatttgttagagaagaagagaaatttggagtttattttatttggcaatttagtacctactattacataaatagattacaggtatcaagcaaa

SEQ ID NO: 6945 - DNA, 406 bp, Diabrotica virgifera
  unsure (1)..(406): unsure at all n locations
  Clone ID: LIB150-042-Q1-E1-F11
tcgatacaagcctctaaattgactcattctaaagtcacagtgtccatttcgcttatttttttgtttatttttgataatattttgcttgttattttatttaattcatcgaaaaaagagccagagccccagcagaatattgttgatgtaaagttattatagacaaataaaaacaagttctggttctaagcaatctgtggatagtggcgtggccgagtggcgtgggtgtaatacaatacacaaccatattttagtcgggcgggaacacattggattttagtggtttttattagttttgtttaaataattattcgtcatggcatctccaaaaacgtggactgttgtgtgcttctgttcggataatgctgtccaggcagtcncaacaacatggataaatggagacacttgt

SEQ ID NO: 6946 - DNA, 333 bp, Diabrotica virgifera
  unsure (1)..(333): unsure at all n locations
  Clone ID: LIB150-042-Q1-E1-F4
agcaatcgctgcccccgttgccgttgcagctcaagctgtagctgtagcccccgcagccgtcggtgttgtcggtgttcccgcccttggtttgggtctcggtaaagtcggacttggactcggaggacacggactcgccggaatcggaggactcggaggactcggtttgggaatcggtcacggagtcggactcgggctcggactcggtggtcacggagttagagcttggtaaattgttgttgccgtttaagattttttaattgtgatgaaaaaactgccatgatccaatttttggtattaatttatttagtgttcaaatanaataagttgcgtcat

SEQ ID NO: 6947 - DNA, 432 bp, Diabrotica virgifera
  Clone ID: LIB150-042-Q1-E1-F5
accaaatcttgagccaaatctacagacaacaacttggacaatctccattgaaccgttatttggtaaacatgagacttgtaaacggagagcaagtatacgaagttcctgaagaattcgttaacgttcaacttctcgaaaaactcttcgccaaacaagaattgatcaaccaagaattgactgaaatcaccgaaagaagacaaccagtcactgaagatgttcactatcagcaacaaatgattaacgaacagatcgaaaaactgattgaacaattagcttaccatcaaaacctcattacacgtgaagttgaacaatacattgttaaaggacaagtagttccccaacagctcgtttaccaacagagattggtttaccaacaagtgcatgaagtaattgaacgtttgaccttacaacagatcttcttgaatcgcctag

SEQ ID NO: 6948 - DNA, 307 bp, Diabrotica virgifera
  Clone ID: LIB150-042-Q1-E1-F7
tatagtgagtcgtattatgccgttccacttaaagtcagttggactgcttacccttgttggtatcagcatcctcaacgttcacaatgtgctcacgtgtgatgaggtttttcgagactatgagtcaccagatgtgcctcgcagggatcggtgagttacaatctatgcggataggcagtagctttcaggctccatttgcttgacagcacaaaacgtttgcagtcaactgcaaatgcagctatctactattcgctcatgagaaggagattcagtactttacacatacgtattagaggacagcaaatgtttt

SEQ ID NO: 6949 - DNA, 428 bp, Diabrotica virgifera
  Clone ID: LIB150-042-Q1-E1-F8
ctcgcgggtcgacacacgcctctaaacacacgcctggtacatcacaagtgcagtggacatcagtgaacatgagaacattagtgttagtgttgtcttttgtgagatgtgcttatgcacaggacactttcgaaaataccggcgttagattagcactgactatatacgatgactgcacaaaagccgatggattatcaccgtgtttaaaaagaaaagctatcacttttctagacagactgacccgtatggataatttcgcactacctgacggagttacggtacaaacagcatccgatgcagtcgctgaaggtccagcccttaccgatgaacaacttgacaacacacttccaacgtcatctgacgccaatgatacagctttaacaaacatgctttttgaaaaagttggcagctttatcggatccagatcgctt

SEQ ID NO: 6950 - DNA, 283 bp, Diabrotica virgifera
  Clone ID: LIB150-042-Q1-E1-G1
ccggtcgaccacgcgtctgaatagattaatattatcatcttatttttaaattttggattaagttaaggtaattgaaaattaataataataattaatttcagaaaattcaaaattggtaatttaacaaaatggataaccttaaaaattaaaaagattgttttaattatttcttcaatagtaaatttatatagtgaagaatatataagaggtgatttatttaaaaatcgatttattttactagttgtaatattttgttttttcaataataatattaattattagt

SEQ ID NO: 6951 - DNA, 349 bp, Diabrotica virgifera
  Clone ID: LIB150-042-Q1-E1-G11
ccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaacttctggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagact

SEQ ID NO: 6952 - DNA, 240 bp, Diabrotica virgifera
  Clone ID: LIB150-042-Q1-E1-G12
gtggcctcggaaggggtagggataatttgcattatgaccaaagggggggccgccctgggggttcaaggtttcggtccgttttgttgcgaattcaggcctcttcaatagggtcccttaatttgatttcatgggctgcctttttcaaacttcggatggggaaaacctgtggggtttcccactttatccccttggtgaaaagcccccttttcgcgattggggttaataccaatggggccccac

SEQ ID NO: 6953 - DNA, 68 bp, Diabrotica virgifera
  Clone ID: LIB150-042-Q1-E1-G2
tgacaaggggaacgcaccctggacggggactatatccccggcgggtatgggggttacccgcaccgtga

SEQ ID NO: 6954 - DNA, 415 bp, Diabrotica virgifera
  Clone ID: LIB150-042-Q1-E1-G4
cgtcggattttatttattttaaaataataaaatattttttagtaaaggtaaagaaaaatttaattaaaggaaagtaaattagaatggtgaaaaaaaatttaattttaataaaggaaaaattaatttttggaacctggggtaccagggataataaattaaaaattaaaaattaataatttccaaattaaaagaagctaaaaaattaaaattttaatggtaaattaaatattttaaataattttttggtaaggaaatgttattcgtttttaaatatatctaattttttaagaaataaattaaatttatttattaacaatatatttataattaaataattttatattattaatattaaatatttttaaggatgagcttaaaaataaaattttattaaaatttaatttttaaataaaaa

SEQ ID NO: 6955 - DNA, 351 bp, Diabrotica virgifera
  Clone ID: LIB150-042-Q1-E1-G5
ttgcaactcactatagtgagtcgtattactccaacagggaaaggtctttgttattcaccattggaacgtgatttgggttacacgatacttgcaaacgggtagtccataattgaagtacctgctgtagtcgcaaccgttaactttcgcaaaagaggctacgacaacttcgaagtgatgatacgtggagtgtctggcagcattggacaaggcactttcattgatcgtgcatgataactctctggaccacctgttgactcagtaaatctcatgtactgattcctggtgtagttgacgacttggctccattagacatcgaattgaacgttacagggttcaatggtccttagtgtc

SEQ ID NO: 6956 - DNA, 406 bp, Diabrotica virgifera
  Clone ID: LIB150-042-Q1-E1-G6
aaccgaccacgcgtctgccgaggcgtggggcaggcttaacgttcgcttcgatctagttattcaaattagaagctttgttgatgttgattttcactgtctagcagtcgatcgaatcaaaaggcttaaacataagctattgagagatacttccgatgcagaatcgggacaagacgatgatgttcaagcagataagatcacatagcctgagtcagagtcttcgaagtcatcaggtcaagaatagaattcctgcaatctgggtaaaagtaagttcgataaattgagcgagttcaaggatacctggtgtgttaatattagagagtactacaacgctgacggtgaaattagacctggtagccaaggaatcatgctaaccatggattagtcggaaaaattcacaggtttcgtt

SEQ ID NO: 6957 - DNA, 393 bp, Diabrotica virgifera
  Clone ID: LIB150-042-Q1-E1-G9
acccacgcgtccgggtcgtctgagcaacattaaaacatgttcttgaaagttttaattgccttccacgcggcggcagcactggtatcgatgtcgcaggcggtgccctccgacattcccgaaagccctttagcgtctccttgcccggaaacgtttacttatggaacgattgataaaccaggttattggacaggaaacctcatcttaagaccagatcatgacattagcggagtctgggtcaggctgatatttgataaggaagtggagaaagtgacactaaacagcgaagaattcataatcaaactctcggaggacagtaaaatggtcaaacttcaaagccccgatatgttattgaaagccgataatccaaaacttttggaagtcactgtaaactac

SEQ ID NO: 6958 - DNA, 408 bp, Diabrotica virgifera
  Clone ID: LIB150-042-Q1-E1-H10
ccaggcctacgcgacacttccaaatttcattcaatttcaaatctgcgaaacctgcaaaaatcaaataattttcatagctacaagtcgatttgccttcgaaaaggccaatgccatcttacagttgcattctgctggtcgtctagaaaagaaaccaatcaacaaacaaaacaccattgagagagataatactgaaatcaataatttaccacaatgcaaagtggaggaaatagatatatttgaagaacctttaattgatctgcagagtccggaacaaattgattatgaattggtagacagtgtcaatgacgatttggtttctgatggggattcccatgaatctgacaaaagcgtagcgtatgtatcgaaagtggacccagtgctactacgaccagacattagcatcgaaga

SEQ ID NO: 6959 - DNA, 371 bp, Diabrotica virgifera
  Clone ID: LIB150-042-Q1-E1-H4
cgcgccggacaatacttcgcactaaagtccgtttcaattaaggtccggccattcaaaataattttaattaaggtaaccttaaataactccaaaatcccaaaaatccaaggtccaaataagtttaagtccaaaaataataaattaactggaataataaattaagttgtacaagggaaccaaagttaccaaatgtacaaaaaccggttcccgggtaaattggaacatggaaacccgtaaagccttgtccaaggttcccaacaataaagaaacctataaattacacaaccttttaccatttccaataattggtgagccttttctgatatataattcaataacatgggaatgataaaatacgaaatacatgcata

SEQ ID NO: 6960 - DNA, 373 bp, Diabrotica virgifera
  Clone ID: LIB150-042-Q1-E1-H7
ttacaactcactgaggtgagtcgtattaaatggacgtgcctaaaatacaaagaatattccagcgtgacagatacatttctaatggcgaaaatgttggatactactcccaatgcggcactcatgatatctcttcgtcaccattaccttactcgagggattccagatcgtaaatgccatgctacgtatatttgggttgacggatcatgagactatgtctatgcaaaactaagactttacattttgttccaacattctcacagtagttaccagtgtggaacttcgaaggaaattcaccagatcaagccacaggatatatctcagatgtctttctgtgcccagtagctatgtcgaaaggtcgattcctcagtggaaa

SEQ ID NO: 6961 - DNA, 396 bp, Diabrotica virgifera
  Clone ID: LIB150-042-Q1-E1-H9
acccacgcgtccgagcaaacaccgtcttcaagatgaaacgatcccaacaagttaccgtcactaaaaccactacgacatatgaagaatacgaatatgaaaccactttctccgtttcgaagttatcgaaacttgagaatttcgttttacctcctagaactactatcttagcagtgtctcagagcggaggagacaaggaagaagacaaaaagtatgtcgtcacgaatcacggaaaagctgatctttttgttgaggtgatacatctcaataaccaagatgatgctccacaatggtttgtagtccaaccagaccaaaccactgagatagatattgaggacaatcttgaacaaagcgtgttgaaagtgagcaacaacagttacgaacaggaagtgtcatttt

SEQ ID NO: 6962 - DNA, 377 bp, Diabrotica virgifera
  Clone ID: LIB150-043-Q1-E1-A11
aaaccaatatggttgatgtcatgtgatgccaggggttaatctggaaatatttttaacatcctttaaaatccgataatataatgtaaccccaactgtttaatatcaatttaagggtttttacccgtacattttggtggcttaaagcatgtaaacctaagttgataatataaaacgggcgtaattttgtccgggaaaaatttagttaatccaacccgtgtaagtaactcacaaaattagagacaacccatttggaggtgccgtaaaattattattaaattcacacacatccatacataccgaccgaccgattttattaccagacatcgctaacttcacattgaggagggtgtcatccacaatgaaagtggtattacatt

SEQ ID NO: 6963 - DNA, 437 bp, Diabrotica virgifera
  Clone ID: LIB150-043-Q1-E1-A4
ataaattttttcttcgtatttgaaagaatatctcgatctagatatgaaatcgtccaatgtcaactctttctgatccagaaataagaatttgagaatgttcccgattggaaacattagtttctattgaaatttagtatggcatttatggcatactaaatacatacggcatatttatggcaacgaattcaccatctgtttgaaaacttttatgaaattccaatcgctacgcagtttaatacgcaattcgaaatatgagtatcgtctgatactagttgggttctgcttagcttgccttcggtccagaccagaccaaggtttcttgggtcttcggtcacgttttcctccctcaaataaacgaccacaaacgagacgtgatagccccctcactataaaaagatttctttatcctcagacagtcttgccttgacggctttttg

SEQ ID NO: 6964 - DNA, 409 bp, Diabrotica virgifera
  Clone ID: LIB150-043-Q1-E1-A8
aaaaatttctatcaatattcacctaacatattgttctcttactctatgttttgttgtattttttcaattctaaatcatttcaattgaaaatcaaaataatttgatttatgtaattcaaaaatgtcaaaagtttaatccgtttagttagtcgatcttcgcacataatgacacgttgtctccgtggcgaagcgtttaatgcgaatgaaccccaatacaacgccaataccaaccgcgctgataagttggttcgaatcccaatagaaacttttattttttttatatattttatgattgtaagtatatttattatataattttattttcagaaaatacgtattcagttaaaaaaattttccgacaattaatgttcagaaatcatttgtggcatttttaatgtgtttgtgtgtgt

SEQ ID NO: 6965 - DNA, 391 bp, Diabrotica virgifera
  Clone ID: LIB150-043-Q1-E1-A9
aataacaagatcgtgtgtatctctgtttcctatactgcgagatttaactcttctacgtttgcttatagtttttcgtttgctctctcaagtgttagtgtgatttcttaaaaaaaaaagaaagagcgtaattctgccgaaagacgccaccgcgccgccaatacccacagcgaattcaatcacgtggtcgtagcagaggttataagtagcgccgtccccgtatattccgtctcttttccaaagtaactaaagaaagaagtacaagtacagtgatcagtggtctgcgaaacatcgaggttcagaatgccagaaacaacatcgacaaatggatattcaaacggccattccggctacgaaatggcggatggtgctgaatttctcttcacatccgaat

SEQ ID NO: 6966 - DNA, 76 bp, Diabrotica virgifera
  Clone ID: LIB150-043-Q1-E1-B10
tgagtcgtattagattattggttattttgagcttctagatgtgtgttattcgttcaaacacaaaagtgtatggatg

SEQ ID NO: 6967 - DNA, 419 bp, Diabrotica virgifera
  Clone ID: LIB150-043-Q1-E1-B11
actcacagaagcatttacgataaatatgttaaaaagtgccacatttctctgttttgttatttcagtgtgttcagtggattactacactgagcgtgatgttaacgcttatgaaaaactattaaacgaagcatttgaatctagcaaaacttacgaaccagcaaccagttctctaaaatataaagcgttgaaatctggacctccagaagatgatggcggtgattatgatttcattgtggttggttcaggatcaacaggatcattgttagctagtcgcctctcggaaatttcagactggagagttttagtgctggaagcaggcaaatttggaaacaatgttactgacgttactgtaatgagttacaaagctacaattatgagcgacttcaattggggttactacagtataccacagaacaata

SEQ ID NO: 6968 - DNA, 340 bp, Diabrotica virgifera
  Clone ID: LIB150-043-Q1-E1-B12
aaaactattcaggtatacagatcggaaaagctgctcaggttagtgtttgcgattacttgcgactgcggacagtgcattttggtgcgtgagacatttatagtttgtttatactcggcgtaccggaagatctttctgtgaatatgttggggtactacctcgttctgctggtggtatacttgatatgtatagctaacatatcagcatatgaaacgccttctccacaccaataccacatccaaaccgacgaaggacctgagcgatatttccgataccagaccgatagtggacaataccgaaaagaaaacgactcgaagatggcaccgtggttgcacatacccct

SEQ ID NO: 6969 - DNA, 416 bp, Diabrotica virgifera
  Clone ID: LIB150-043-Q1-E1-B3
aaataatttaggttaagaattggacggagtaaaacagaataataatggtcagaatgtcaagaaattcttcccaaatattttgtgcgcctgtgcgaacttaaaacctccgcgaacgctcgattttgtaatgcgcagaatttccccctttgggtacgttcgggttgtccagcgcgaacaaagctgctataactattctatacagcgtttcaggttaagaaccgaacgttgcttagatagaccaatgtatgtcttatggaggatagaagcgcgccgatgccaagtcgtactgattagattgaatcgaatatcggcaatcgagtagccacctgtgcccgagaggtttggcaatactgatctccataagcgcaatgtttcgcacttaacgtgaaacaaagtatgtttagtaaatagttgac

SEQ ID NO: 6970 - DNA, 394 bp, Diabrotica virgifera
  Clone ID: LIB150-043-Q1-E1-B4
accaaacgtccgcggacgcgtgggcggacgcgtgggtttgtctgtgcgaacttctaacctcatttttacagccttaacatacgtttgacgtctgttaatgctttttaactaatagagattgtctaaaatggcagtaatcgtttacttttgtttcttccgggatgctcaaaaaccatcaacacagtttgtataggaactaagatttttggggagactgaaggagacgttgacaggggttctcatacctgcctagagaagataatacaataatacattttatatatttatgaataatatagtaataatgttgcgcgtgcgttgtctactaatcattgtggatttggtcgatcttccgatttagtttacgatataacactatatgggcaactttttt

SEQ ID NO: 6971 - DNA, 385 bp, Diabrotica virgifera
  Clone ID: LIB150-043-Q1-E1-B9
cggtcgacacacgcatccaaatgattttaacaaagagcattgattattttaagcttctagatgtgaaataaacggtcaaccacaaaaaaaaaaaaaaaaaaaaaaaaaaaaaaaaaaaaaaaaaaaaaaaaaaaaaaaaaaaaaaaaaaaaaaaaaaaaaaaaaaaaaggaaaaaagatcaaagggataaaacccaaaaggaatcaagcattaaaaactcataaatctacaataaaatcccttaaattgaattaacggaaaagaaattcaataaacgtcaaatttaaaaaaacccaactgtaaaacacctgactgaacatacataaaatcccctttacaaaacccgccataaaaaaaataaggtacgaaccaataggccttcaca

SEQ ID NO: 6972 - DNA, 262 bp, Diabrotica virgifera
  Clone ID: LIB150-043-Q1-E1-C2
tgagtcgtataatgcccttagttttatgcagtgcgtttttttgtgagttgaggtagacacaagcattctgtttttacagaatgtttttcaagacagtagtcctcgtgttccttgcaggcttccggacggtatacgcggcccagccaaagtagtgtgttacgttaggaattgggctgtatagagagcatgaggtggaagatatgctttggacgatgtccgagttgacctatgtggtcatttagtttattgatttagttggagt

SEQ ID NO: 6973 - DNA, 414 bp, Diabrotica virgifera
  Clone ID: LIB150-043-Q1-E1-D10
atcatcaaaagttttatagtgataataataatatatgtgattttatcagatttgtaaaacagataactatgggattggacaaagtaccatggaggtttattagagtaaagggggatgataatgtaagtggtacacaaattgaagatagtcaagtgagttcgagaaccagtagagagactgtaaactcgggaaatgctttactatcaaaaatatatacaagaaaaatccgatggagggaaggacaatattccttaatcattataagtgcagtattaacagtcttcggattggtgcagatactatttcctccatttgatttactcctggatttacgaatacgaatgacccctggtcttccagcatatgaatggtgggtggttccgccaaaagatgccatagttaaaatatatcttt

SEQ ID NO: 6974 - DNA, 363 bp, Diabrotica virgifera
  Clone ID: LIB150-043-Q1-E1-D12
acggcttcaagatggcgtaccgaccacgatccatgcaagagagcacccaagaatattcagtggagacgacgacatattatgaaacatacgaatatgaaaccactttccccgtttcggagacatcgaaactagattatttcgttttacctcctaaaactacgatcttagcaatggctcaaaacggaggagataagggagaagacaaaaagtatgtcgtcaccaatcacgggaaagctgatctttttggtgaggtgatacacctcaataaccaagatgatgctccacaatgggttgtggtccaaccagaccaaaccactgagatagccattgaggagagtcttgaacaaagcgtgttgaaagtgt

SEQ ID NO: 6975 - DNA, 433 bp, Diabrotica virgifera
  Clone ID: LIB150-043-Q1-E1-D2
aacacacgtccgcgcatattaacgacaagattactttaccaaatgcacaagcaactgagatagtgatatcaaaagctctagagtcaattatgtctgctccactcgcagtttctgacaacgttccaaatcaaatctgcgaaacctgcaaaaatcaaataattttcatagctacaagtcgatttgccttcgaaaaggccaatgccatcttacagttgcattctgctggtcgtctagaaaagaaaccaatcaacaaacaaaacaccattgagagagataatactgaaatcaataatttaccacaatgcaaagtggaggaaatagatatatttgaagaacctttaattgatctgcagagtccggaacaaattgattatgaattggtagacagtgtcaatgacgatttggtttctgatggggaattccatgaatctga

SEQ ID NO: 6976 - DNA, 255 bp, Diabrotica virgifera
  Clone ID: LIB150-043-Q1-E1-D3
acgcgtccgaccacacgtccgcccacgcgtccgcgtcggtcgaagtgaaaggttgtaggtgagagcacacttaaaaaaatcaatttggtagtacattttaattttaataatagcattcgttgtatttttaacatatttacgtgatacacatctaagtaatacggagaatctgtattttaccagactttttgagttttattgtagtcgtaatatgtatcagcagatatgcctagaggtagattcccatcgtctcct

SEQ ID NO: 6977 - DNA, 378 bp, Diabrotica virgifera
  Clone ID: LIB150-043-Q1-E1-D4
aacacgcgtccgaattttttatcgtattttgacaaacaatcatacgtattaaatcaaatcataaaataaagaaaaatacatttttccagttaaaattcgtttcatgataatatggcgtataccataaagatatttaggatacacgttacgttagaagtaaatattggttctttaaccttccgatgaccaacctttttttgttacacggatgaccaacgggggtaaaaaatgaccccaagtcaaaaatgacaattgacaaaaaaatgaagttgttttaagaaatgtaataatgtattcgtaattttaatgttactattgtataaataaattataaataaacattagtaaaacatatttttaattacaactgaacaaaaa

SEQ ID NO: 6978 - DNA, 340 bp, Diabrotica virgifera
  Clone ID: LIB150-043-Q1-E1-E1
ccgcgagttcacaagcggttttttatatagatagtaaacggttcgcgaaatgcttgggaaagcattctttttttgagtgctctgttggttgtgcgagcagcgcagtctgatttttacagtgaccttagcctcttccatgagctccaacaaccatacagggcaaattggaatttggacaatcccgtcgtgaatccaagacgcgcgatcgaagaggaactagcatctgcagaagacgacagcgatgaacgcgaacctctagccaaagactacaaagatccacctgctgcaagttcggagcaaaaacctgtcttggtgcctaaaccaaagcccaatctgaaat

SEQ ID NO: 6979 - DNA, 409 bp, Diabrotica virgifera
  Clone ID: LIB150-043-Q1-E1-E2
aagtgagtcgtactaacgcgtggggcaatattaggtagacaacagtcaattaaagccaaacgatcccgacaaaaccaagcaaacgaagtgaatcttacaagatcaaatggaatagaaccgcaaataaaagtagaaaataacatttttaatcaggaagaagtacaattaactgttgtagaaccaagggcaaagtatgaaagaacagctgtcagcaaaagagaagaaataggacatgattcaaagctagctgccgaaataaaaaataaagaaatggcacaagttgaaatgatttatcctagtgaacatgaagaaatagaaaaaattaactatgcacaagaaagagaaatacatatcgacttccaaaaggttggtgatgaaataatattccctaagttaacaaatagaacac

SEQ ID NO: 6980 - DNA, 434 bp, Diabrotica virgifera
  Clone ID: LIB150-043-Q1-E1-E3
accgcattcaagatgctccgcgtacaatctcaaggaagttagcaccaagaatattcagtggagacgacgacatatgaaacatacgaatatgaaaccactttctctgtctcggagacatcgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccagtgagattgctattgaggacaatcttgaacaaagtgtgttgaaagtgagcaacaacagttacgaccaggaggtatcattttctgctgaaggtggtctcgttattgacgacttggaaaacaacat

SEQ ID NO: 6981 - DNA, 220 bp, Diabrotica virgifera
  Clone ID: LIB150-043-Q1-E1-E6
tgagtcgtattagacgggtgtaggtatcgataaattctgtgaacgtttcatttgaggaaaattcattgcacaagccatggctcgcacgacgcaggctgcacgtaaagcagcacgtggaacagggcggcgaaaagagcttgcgacgaatgctgcaggatacgcagcaaccgcatccggaggtgtcaagtttcgcgatcgttacggtcctggtacagtagcg

SEQ ID NO: 6982 - DNA, 405 bp, Diabrotica virgifera
  Clone ID: LIB150-043-Q1-E1-E7
caatatcatatatgattatagtaattttcctaatgaggtaaccttactttaggatataatggaagaaaataaacaagaaaaaaaatgtttgaagctttttcaaactaatagggataaaataagaaaacactgggataaaacagagtcagaggtggaggaagttttgacgaaacttagagaatgggcaagtaggaaagagtttccagaaataccaagtgatagtatgctagaattttttgttacaaacaataaatataatatagaaaggaccaaggacaatattaaatcatattatgcagtacggaaaaatatacctgaattttttaaaaacgcacatccgagattacctaaaatgcaggaatgttgggaaatgggggtttaagttcctctagctataccacatga

SEQ ID NO: 6983 - DNA, 396 bp, Diabrotica virgifera
  Clone ID: LIB150-043-Q1-E1-E8
atttattttaaaataataaaatattttttaatagaaataaccatttcttttatttgatgatagggactcagtgtcgcgagagaagatttcatctctacacaagaaagatttaattcatgtaccgtgtgttccaaggattattacttaataattacctctttactaatttcgactttaatagagctagaccagtcgtattttgatcgtcagacatatactttaaatgatttttttgtgatgacctgtcagtcgttgttatacatatctcattttttacgaaatacattatgtcttaatattatcaatatctttacaagtacacaattttagagtattaatatgacatacttttagggatgacctcaaccataaaattttactaaaattgaattttta

SEQ ID NO: 6984 - DNA, 418 bp, Diabrotica virgifera
  Clone ID: LIB150-043-Q1-E1-E9
atccgaattactggacaaaatctaattattggggttcccataaaacattatttttttattaaaaaattgctgcagaacttacagaaatgtctaacattgtggatagtttaacagaaatgggattcagtaggcaaagagcagaattagcagtaagtcaaactggtagcaataatcttgaacaagtaatggaatggctattgtctcacgaagaggatgaagccatgccagtaactacaaatcctccaaaagcaccagaagcagcttcagaaattgctagtgaaaatgataataatactcaatccaatgctgatactgctgtttctgaggaggctgaagctgtagctaaatcaattaaatgtgatgaatgtgggaaattgtttaaaaccaatgaagaagttgaatttcatgcttctaaatc

SEQ ID NO: 6985 - DNA, 440 bp, Diabrotica virgifera
  unsure (1)..(440): unsure at all n locations
  Clone ID: LIB150-043-Q1-E1-F1
accaaattgtctcccaccaccaacanattaaaggatttagatttttcattcaataaggaaaatattgatgaaaacaaggataaaacccctgtggctaaacaaccttctaccttcgaatacaacagtaaagagataaccagtatgatcaaatctcaatcccttagtacctttaaggatcaatcttcacctcanataggtatggtaaaaagtcagtcagatctggtcacatttaataaccatatagttggcatacctataatggaagttgaaagagagcagtatcaggagataaatgagaaattacagaagtttgaggatgaggaaatgaagaagcaaggtgtgattcaagatttagaattgcacaataaattgttaaagcaagagatggaagaattcaagttagaattacaacgcactcaaaggtcattagaacaaaccaa

SEQ ID NO: 6986 - DNA, 428 bp, Diabrotica virgifera
  Clone ID: LIB150-043-Q1-E1-F10
acacgcatctagattgattactctgaatgaaagacttacaagatagatatagcaaaatatttatgctaaaaatatatcatcaggatgatgtgcactccgtagccctaaataacagctgtagcttattggcgtctggggctagaggaggtgatgtaattgtttcgaaagttgaacctagtgttactccccaaaatataaataaagtactttcgtggtcatatcacgatgtaatttggaaagttggattttcagtggaaaacaaattagcaattggtacagcgggtcgccattactacagttatctctatattcgcaatgtagacaggattgacgtagaagaacttgtcttatcttatcagtcagtaaaagaaggaatccatgatataatatgggatggaccgcataagatatggacgtgtggttatgat

SEQ ID NO: 6987 - DNA, 403 bp, Diabrotica virgifera
  Clone ID: LIB150-043-Q1-E1-F12
gtttcgttacacgcctctggttattttcgtattaaaaaaaaaaaaaaaaaaaaaaaaaaaaaaaaaaaaaaaaaaaaaaaaaaaaaaaaataaaaataaaaaaaaaaataatagggcgtcgaccctatgggttatgttctctttaatggtagttcgtattaggtcatccctcctgggatttccctgaagttctttttcttggccgtcttttttcacatcctcgtttgggaaactctcgtggtatttcagttgattgcctttttagcccttccccctttttccacaggcggtataacgaatgggacccccccagttgtccttccttaaaatttgtgaatcttgatgttaaacgtggcgtcaccgtttttcgtgccattatcctcgtgggggttcctgttgcctt

SEQ ID NO: 6988 - DNA, 427 bp, Diabrotica virgifera
  Clone ID: LIB150-043-Q1-E1-G1
aacacacgtccgctgacatttctacatccgaagcttgatcgagcaaagttttagcttgaataagtttaattacttttttattaagactattgaatttaattgaattagaaatttccaccttatcctgaacatctgacatagttattaatattgatacaatctattatttcgaccaaagaatcatacattaccttaagttgaggtaatttaatcttccatagtggtcattgcgtcaggccatggagttggagtatctacattgtaaatgtcgtgtaccccatcttcaatgctatggcatgctggacgagccatacagtctgtaatcaacaccccgaggtgtgagcgggaacacaaagtgtatcaatactcttacgcttatgaagcgcacctggctcatcataagggccttcacattttactctttttc

SEQ ID NO: 6989 - DNA, 386 bp, Diabrotica virgifera
  Clone ID: LIB150-043-Q1-E1-G11
gcgggtcgatacacgagtctgcacagacgtctgctcaacgcgtccgattaattattatcttctacacgctattcggcgttaactacaataaagtatccttcgatctgtagtttccattaatcaattgataactgcgctatgttttaccgtattaagaagattctcgtgtgttcgtgaagtgaagtagtttgtatgaaatcggaaaatgtttaaaagacagagatcgaaaaatagtggttctccgctccaaaacggtgaatcgcaacattctcacatggaaaacattgtccctgtgtcacaattttccaaaattacgcggcaattcaattgcaaactggccaatggaattcgaaaagctttcgtatcaggatttccaaaggtgcaaa

SEQ ID NO: 6990 - DNA, 448 bp, Diabrotica virgifera
  Clone ID: LIB150-043-Q1-E1-G12
aatacaacactctacagtcactcgtactaacgcgtgggtggaaatggaggtggtaatggaaatggaggtggtaatggaaatggaggtggtaatggaaatggaggtggtaatggaaatggaggtggtaatggaaatggaggtggtaatggaaatggaggtggtaatggaaatggaggtggtaacagtaccagtaccacagaaggcgctacaaagcctactactgaaaaagctactactttaaaacctactactgaaacacctactactgaaagcaatgacacagatgaaaattgcgatgaaaattcctcagaagaaagtaatgaaaaatctactgaaagaaacgtcacagatgataatagcgacgaaaattgctcagaagaaagtagtgaagaatctactgaaagaaacgacacagataatggaaatggaggtggtaatggaaatggag

SEQ ID NO: 6991 - DNA, 222 bp, Diabrotica virgifera
  Clone ID: LIB150-043-Q1-E1-G3
tgttagactagtgtctgataccatcgaagatgatctcaagggattatataatcttcatcgatgtttaatctaatctatgtgaatgcaatcacactgggttacacatcgatacacagttgagacctttgtcagtaggatcattgattcgagtcagccgagtaagattggattatgtggttaaacgggtagtggtaacgacgctggtacaagcggacgattcga

SEQ ID NO: 6992 - DNA, 428 bp, Diabrotica virgifera
  Clone ID: LIB150-043-Q1-E1-G7
acaagcctctaaattgattctgaggactagaatgcaataatggcagtgagttcgtttctcctgtgcttcatacaaataaaaaaactccgaattggtttaactttgccggtaaaacttattacgtagatactgtctttaaggctaatttctacaaggcgttacagttctgtcgacaacaaggaatgcatttgttaagtatcaatagtcaacaagaaaacgacagaattggaaaatttattaatgagaatggtttaggatacggccactactggacatcagcttcaaaccaggtcggagacggccagtgggtctggctatccactggacaaaatatggtatactcgaattggtaccccggggaacccagcgggaaaaactcccaaaataacactgagcactgcgttgaagcccgacattgggctcagcct

SEQ ID NO: 6993 - DNA, 346 bp, Diabrotica virgifera
  Clone ID: LIB150-043-Q1-E1-G9
aaataatgaaaaatgaaatgatgcaacaaacaattgcaatttgcaagtatatttatctacagaatgtggaaataaagtttatccgaatttactttatataactatgtatagaatcaaccaaatttagtacttttagaaggttctgcaagcttacaagtgaaaatggttgttatattatgttaatatcaagactgctgcaatttctatttaggaaatgtgacactggaagggccttaagctgactaggccatgttcatacaatcaaattataaggatagagcctaccttgattagtggattactgcgtagaattagtcctaccactaagctcgtagtccgtagccac

SEQ ID NO: 6994 - DNA, 416 bp, Diabrotica virgifera
  unsure (1)..(416): unsure at all n locations
  Clone ID: LIB150-043-Q1-E1-H1
gttattttttattatttttttgtcaatgttcaatcagcaaatcttcaaatacaaaaacggataccatattacgagggtaagttttaggtactctattactcacacgggttgtgctcagctcaatcatgattgataaaatatttttaaaacttgtctttatgttctttttcaataatttcgtatacattttatttcgaatcttgttatgaatgaaatttaaaacatttgcggcatttttaaacgaccgagagcattttaactgctcaaagaaacgtaaaaattgtcgaatattgtcatactggcctttgtctttcttcttgatagatgtagatgtaaaggcgcatgcgtaaaagctgacagcaacttctctgcgtctgaattttcaaaattganatatctcgtgcatgtcatatgcc

SEQ ID NO: 6995 - DNA, 421 bp, Diabrotica virgifera
  Clone ID: LIB150-043-Q1-E1-H11
ctcacgggtcgatacacgcgtctaacttcatgccatatactcgtattttattattaagaatttagcaattatttcttaaaaatgatgggtaacaaattaatttgtttgatgatttgctttgcctgcatttcactgtatctgatggaatctgtcgaggcgaaaaattatgaccctaatcctcctcaacgttcgccttcacctcaagaacgaggtcgttcacgtaccgttccagcccatctgcaaaatcaaggacagaatgggaatggtcaccaaaatgggaacggacaacagaacggaaatggccacactaatggtaatggacaacaaaatggtaatggacatcataatggacgccgttaacaaaatagtactgacagttcgtttgtgaatttgttaattttgtatatgacaaaggcataat

SEQ ID NO: 6996 - DNA, 409 bp, Diabrotica virgifera
  unsure (1)..(409): unsure at all n locations
  Clone ID: LIB150-043-Q1-E1-H12
tgagtcgtattaaacngtntttgtctactatatactacaaccatgggcgtatgtttcactttatgctttgacttaatttttttgaaagtgaatcgtgacgcatgggaaaagttatagcggacgaacactataatggcccgtttataaggtgccccttttggtcttaaaaattatcttacctatttttatattctcataagaaataagtaatgcatctgatatgcctaaattgttgctcggtatagacagctaatttttattttcaaatttattttgtttttgggtcatatcgaaacacacacctttaatgttatatatggtacggaatatgactcgcgtaaatagaaacttgtggcacacattacattatggtttttctcatgagcatttttcagttcgtcacagtttt

SEQ ID NO: 6997 - DNA, 401 bp, Diabrotica virgifera
  Clone ID: LIB150-043-Q1-E1-H2
agcctctaaagtgagtcgtattataatatgtcaatgttcaatcaacaaaatcttcaaatacaaaaacaaggtacggtattacgatggtaagttttaagtattctattactcagaatggttgtgctcagctcattcatgagtgatataatatttttacaacgtgtctttatgttcattttcaagaatgtcatatacattttatttcgaatcttgttagcattgaaatttatcacatttgcggcatttttaatcgaccgaaagcagtttaactgcataacgattcgtaaaaattgctcactattgtcatacatggcattggctttcttcctgataaatgtacatgtaaaggctcatgggtaaacgctgatatcaagttctctgtgtctgaattttcaagattg

SEQ ID NO: 6998 - DNA, 417 bp, Diabrotica virgifera
  Clone ID: LIB150-043-Q1-E1-H5
aacacgcgtccgggccctttggagaaaaatggttccaatgagagtcattcgaagctcttcacatgtcgttggagcaggtatacgacgtcttacaagccttttgagaaggctccatatatgctcaataggattaaggtctggactttgagcagactagtgttacaatccttgacgtgtattttgcctacatctaaaccagactgaaccctacctatcggaaaaaatttgtttattaaacattttattaaacataaatcattaaaaaagttaattttgatggtgctgtagcaaccaaaatccaaaaaaactcttacagttatttttttaaggacatgtagacctcaaattagaaaaaggaaatattttgatatggaagtagttcaactgtgtagaaaattagttgaatttgaagcgttt

SEQ ID NO: 6999 - DNA, 417 bp, Diabrotica virgifera
  Clone ID: LIB150-043-Q1-E1-H6
ctttggagaaaaatggttccaatgagagtcattcgaagctcttcacatgtcgttggagcaggtatacgacgtcttacaagccttttgagaaggctccatatatgctcaataggattaaggtctggactttgagcagactagtgttacaatccttgacgtgtattttgcctacatctaaaccagactgaaccctacctatcggaaaaaatttgtttattaaacattttattaaacataaatcattaaaaaagttaattttgatggtgctgtagcaaccagaatccaagaaaactcttacagttatttttttaaggacatgtagacctcaaattagaaaaaggaaatattttgatatggaagtagttcaactgtgtagaaaattagtttaatttgaagcgtttactaattggtgaaatt

SEQ ID NO: 7000 - DNA, 424 bp, Diabrotica virgifera
  Clone ID: LIB150-043-Q1-E1-H8
accacgcgtccgatgaagtgtctagttcttctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtagtcttggatg

SEQ ID NO: 7001 - DNA, 409 bp, Diabrotica virgifera
  Clone ID: LIB150-043-Q1-E1-H9
cacttgtgtgaaaatgtctttataatttacatttttaggtatattttaaaactgtagcatcatcacgattatatgtgtcttatcaaggaaatactacagaagcattttagttttagtttcactgtatttagtcaatgggaccacaatattagtttacttgggacgtatccaaacatttggggggtttaatgttcagaggagtactacagtcatatcatttttatgtaaatatatgaaagctgaagccaaatctcgattaaaactcgcgtttcgaaaaattactataagccacaaatgttttaataacattgtgtttaactaatggtaccacagtagtgaattaattgtaccgtacacaaacgttttagggggtttaagggattaatacccccataaaattttatggggt

SEQ ID NO: 7002 - DNA, 285 bp, Diabrotica virgifera
  Clone ID: LIB150-044-Q1-E1-A10
tattaaaatatttttaagtaaaggtaacgaaacattttatttaaggatagttaattagtattgtgagagaatattttatttttagaaaggaaaaatttatttttggtaccttgtgtaccagggattattaattaagaattatatattaattatttccgaatttaaaagagctaaaaaattaaaattttaatggtaaaataaatattttaacaaattttttgggaaggaaaggtaacccgttttaaaatatacccaattttttaagaaataatttaaatttattta

SEQ ID NO: 7003 - DNA, 346 bp, Diabrotica virgifera
  Clone ID: LIB150-044-Q1-E1-A2
aggacacactattttcgggggacacctgtaaatcggaccctttcaacaacataatataccggatcgagttcactctttagtgtaacattagattgatgtgcatagatccagaaagtctccaaattctcaaagaaaaagagggcaaagatacctttcagttcaaggacacttatttgtttgaaccaccttttttatatgggatcaatcttctaaaattctaaacgcttcgcacagaccgaaataaaactggttgataaacagagaagggttcatatgtttcgctctaaagtgtttctattatattttttacttacactatacctaccaacaagttctcgataaagct

SEQ ID NO: 7004 - DNA, 436 bp, Diabrotica virgifera
  Clone ID: LIB150-044-Q1-E1-A7
aattgcaataagattattaagcatacttaataaatccgacccactggcgtttcccttttaccatacttaagtttgacttgcgcgtctgtgaaaactctcttctaaagaattaaaactttagttaaagttaaagtagtgaaatcaaaacgcagcagcaatatgaagtgaaattacaaccgaagtttgacccacatagtttaaagaccaagctagtgtacatgtgtttctgtttattcgtgatggtttgttaatgaaaacttcgtgaatatggtgtcttaaaaaacattcctcgaaagaaaatgtccaacaaaaaggcaggggttaaaactaatgcggaacctgcagttttacctcctcgctatcagccaccccctatgcctactgggcagggcattttgaaaaactcgcccactgaacctgccaaaaagcctccaaa

SEQ ID NO: 7005 - DNA, 400 bp, Diabrotica virgifera
  Clone ID: LIB150-044-Q1-E1-A8
aatggaaataaagaatgtaaatatctataggtcttcccttaatactgttttaccaactgcttttaaggttgtaaaagaatgtgcgagaggttcactgacataaatattatagaatagtcgattacttttcgctttcaaagttgctacagttcgtgtgaaaggtgtatgttttggtgtgaatttgtttacagtggtagttttggaaacagtttttagtgccatttaagatatttttcaagacaaaactttgtgccaatttataaatcagaatgctcgacaaaacttttacaaacgaaactgccacacaaaacgataagactgtatattctacaatcattagacataacattaatacacttagacatgttataacaattgaaccgttagctggattttacca

SEQ ID NO: 7006 - DNA, 395 bp, Diabrotica virgifera
  Clone ID: LIB150-044-Q1-E1-B1
caaacgtcctgccacgcgtccgcccacacgtccgcttttaacacgaagagacgaacttttcccactggctagacaagttgtcaaggattccggttgttattactcagaaacacaattatctacagtttatatgaataaaccaggaaatatgggccatgatcgggaggtggatacatcagctagagcgagcccaagactaagaggatttgaaaatgatagatctataagcaagaggccaaaaatggaagccacttccgactcagacgaccggcaggattatgatgaagcacttgtagtaagaacctctatccattcgctgtttcaacacaattctaaaaaccatcattcaagcgcaagatgcaatacgtcacgaagatcctcagtgggggccgatg

SEQ ID NO: 7007 - DNA, 240 bp, Diabrotica virgifera
  Clone ID: LIB150-044-Q1-E1-B12
cgcgtccgattaaaaataagatttgattgcaatttaatttttaagtacaagttaggattagccattttcagattttacagtcatttcattatgtatgcttgatatattagtagtttgatttttcacgacttttctatcaatctatctgtttagatggggtagttctacgtacctgactgactggtattagtcttgatatgttgtgcaatcagttcagctttggaggtttcttcaccgcac

SEQ ID NO: 7008 - DNA, 437 bp, Diabrotica virgifera
  Clone ID: LIB150-044-Q1-E1-B2
ccggtcgaccacgcgtccattcaaatttatatatatctaattttttaagaactttattaagtttatttattatcactatatatataatgaaatatttttacattagtaagattatatatttttagggatgagcttaaatttagtatttgattaatatttagcttgtacatgtaaattatgattaaacatttacaaatttcaaaatatgttattatttatttttatagattataatgtctacttgttagaaattttttattaatagatagatttagttaagcgatatttactattgatgataatattagtattaaaaaattgtagatttagtacatatatataggtttaatagatgaattcagcatcatttttttcacctgtataggaatagcatgtccatttgtatttaatataaagtcactcctgcccactgatta

SEQ ID NO: 7009 - DNA, 437 bp, Diabrotica virgifera
  Clone ID: LIB150-044-Q1-E1-B3
gggtcgacccaagcctctataataagtcgtatgataattaatttataaacaaatgtaattaaaaaaaaaattagtttcaaaaagttgaacagtgattgctggtgtaaatacaatatcatttgaaataaaaaggcaaaatgtcttcaatgcaaaaaacggatgatgtgttagaaaaagttacaaaatcattaaaattatggaaaaaattaatatcagatgtgtgcgaaaatgatgagaccaaacaaaaccaattgaacattttagaaactcatgtaaaagaatatagtgagttggaacataactttaatacaaccagtaaggcttttcagaacttggatgagaaattaaactcttcagaaaagatagaagatatagaaagtttgtatcaggattgcgtggataatgtaacaacagggtcatcaataaaccatcaaaaa

SEQ ID NO: 7010 - DNA, 416 bp, Diabrotica virgifera
  Clone ID: LIB150-044-Q1-E1-B6
acggacgcgtggggttttgcaagtgcccgtgtaggggtgtgaatgaccgatttggatttttgattttttataatgaagattattcttcttatcctgctagcgatatgtacgatacttagcgcagcggaataccccagatacaaaggcaggcctccacctccacgacaacgtagggtaccaaccaaccaacagttctccaagaaatggcaccaaggaggtcccttaatacaaaatttgccacaaggtattccacaaggatttccgcaaggcgtacaaggagttcctccaggacacggccagttcggcatacgtgggccgcctccaagacagagacccgtcaaccacataccggtcttaatggtgccgaacaatgttcctcaaataaaacatcataagattacacaacctaatggact

SEQ ID NO: 7011 - DNA, 431 bp, Diabrotica virgifera
  Clone ID: LIB150-044-Q1-E1-B7
acccacgcgtccgaccaaatggctcaattttcatccagttatgcttattaaaaatccaaaaccggctgtaagaaagtggctaaaacgaggggctgtggcgttattcgttatagaaggagcaagttttgttggaagctattttctttggtatagagtcaacacagatagagatacaagaaagtatttataccagaattatccatcagttttggaagcatactataaaattggagaaacatttgattcccaaaatcaaataagacaaattgatttggcttactggaataaggaatcttaatggcatctagacttgttagatcattattctggttagttgcttgtggaggtgtcagttatggtcttttaattttgactacaccaacagaagaagacatcagaaaaagaaaagaggaattacttactgttaaaga

SEQ ID NO: 7012 - DNA, 424 bp, Diabrotica virgifera
  Clone ID: LIB150-044-Q1-E1-B8
aaattacttccaatctccaacaacttgctcttgctctcatgagcttactacaacctcagcaacagaatccaccatcgttgctttctttgaatacatctcctggttataatcgggacagagattttggcagaggccgtgatttcagacgacatgagccttacagtaagaaccgtcaaggaggaggtttcaatatagatagagcgaggagtcaacatcattaggatcagatgaacgatatcgaggatggaactgatggcgattgatggagaaaccaagagagactggaaatatgagaagagcaccagtgatactcctgaaactgaggaagaagccaaggctagaaaggaacatgaagagaacgaatgaccttattatgatatacccactaaattgttgagctgcgttgtctgcatcaaacaaatgt

SEQ ID NO: 7013 - DNA, 381 bp, Diabrotica virgifera
  Clone ID: LIB150-044-Q1-E1-B9
accacacgtccgcagtaatcaagaccagcaaaaatgaattacttggaattctttgtttgcattgttgcctacgcatctgccacagcagtgaatctcgcatcattcttggaagccaccaacacaacaacaacatgtgcttgcaaacaatccttggacaatatccttgccaaaataaaagaacaaaacaccaatttgaacaatgctaatgtcacactgaattccatagaagtaaccattgtcaaaaatgtcagtgtcgaagttgccaaccaaacacaaacactatgcaagttagaagaacgcctttctgtactcatcaaaaaagaagttaacattggcgttatactcgacgtccaaactactaatcttaccaacatcgtcaac

SEQ ID NO: 7014 - DNA, 386 bp, Diabrotica virgifera
  Clone ID: LIB150-044-Q1-E1-C10
accatattcggggcacctacgcgtggctcatcaaaaaccgatgttcgtccacgttgaaactcattaaaccaatttttgacagttgccatcgaacgagaagaggcaccgtacacagcatccaagcgctctttgatgtcgctgcgggatttcccttccaaaatcataccataatttggatttggctgaaattttgacattagccgtttacgagaacgcattaaatgacagtacacttcatttgcgatagtggcgccatcgggcggagaggctaagaacttatctgactgccctagtatctgagtgtttgtactatgtattcaaataatattagcgatattttttttgtaagaaatctcaagaattataggaaataaagattttgaatt

SEQ ID NO: 7015 - DNA, 430 bp, Diabrotica virgifera
  Clone ID: LIB150-044-Q1-E1-D10
taaggacacttgggaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaacgaattcggcaacattttt

SEQ ID NO: 7016 - DNA, 425 bp, Diabrotica virgifera
  Clone ID: LIB150-044-Q1-E1-D12
attcctcgcatttacaacctgtgcattatactatactgtgtgttatttgaccgtgaagcaagcaaacagttcggtttggtgacatcgtactccgttgttatactgtctttgtttcaacgtcacattagttcaatatcgtagaccaatgaaacacgcaataattgcatcattaatagttttcttaataactggttcctcgagtctacaattaataaaagaatggaactttctgacatttgatttcccgccacaattggctgctcataattttaaaccagaagctacagtgcccactggtattgagataactaacgacaggatattcatctctattccgaggttaagatctggagttcctgctacattaacctctattcccatcaataatccaaaagatataagtccggttcttcaagcgtaccctg

SEQ ID NO: 7017 - DNA, 422 bp, Diabrotica virgifera
  Clone ID: LIB150-044-Q1-E1-D3
acaccctgaagtaagtcgtattaaaccgttggcctgatctcgtccagtttgcttttgcagtgtcagcttgggccgttttgctaggaataccaacagtttctctgtgaatatactgtgttaattgctaagataaaaatggtatttaaagaacaactagctattcagatttctctgagtttttctctaagtatatgcacactgtgtcagatagcatttccggaactacctacgcatagactggatatcgaccagacatagggaagggtacccctttatgcaccaaatagatgtccagaaaatcaactatattagcatggataccagcatcatgactggatctgtgattgtcgcccaaactagatctattaccctccataagatttctgttatccatgcatagcggcaaggaccatgtaaagatg

SEQ ID NO: 7018 - DNA, 414 bp, Diabrotica virgifera
  Clone ID: LIB150-044-Q1-E1-D5
atccgattaggatatagagtagtcgcttcatcttctactagtgtaaaacaggactacaatgagtatatgtggactatgagaaaagacttttccgagccagaaccaattagtgaagaaaaattacctgaatttaaaatagatcataagttagagaataagctctcaccttctgaagaaatttgaggttgatggatacaaaaaaaatggagataccagcaggtgtactcatgtctactggaacttacgcatatgtggccattaagggatccttatatgctaacgacagtgctgtttttggccttaacgaggtagagactaaggcgttggtgaaaaaattttcaaattcccagagagaggttataaatggaatattactatctgcgtcgccgatgcaagtagttaacgctttgggtc

SEQ ID NO: 7019 - DNA, 450 bp, Diabrotica virgifera
  Clone ID: LIB150-044-Q1-E1-D6
acagtgatacagcaccatccctatataaaaaatgcggattagttgtgtattattcattggtctagtcacgtttgccgccctctgttcagctcgaccagctgagaacgacgctgactacgatgaagaaccagcacctccaccaaaaaaaccagcgaggccattaaccagcagaaggaatccactaagcggtagaactaatggaaaagcggcaagtagcaccactacaactacgcaagcaccagtggaagaagaagaagctgcggaagaagaatatgatgaggagttaccgccagaacaagaaccaagttcgacgacggaagcccctaagaaaaattttcttaaaactggagtagttaggccatttagaagcaatgacgaacttctggcagctttaaaaaagagaaaggagcaagtagtccataataagatcacaaaccctgtgcaatcgaa

SEQ ID NO: 7020 - DNA, 430 bp, Diabrotica virgifera
  unsure (1)..(430): unsure at all n locations
  Clone ID: LIB150-044-Q1-E1-D7
atctagaattgtccatatcatctttccctagtaacccttagtgtagctgcctactacccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccaggctgatgttcttgctgatcttttcagtcaatatgagggtattgtagatgaccagaccttctacagtttgttgaacaaacttcaacatttggtacaagctggagtcatcaacagagtantcttggatgttgtaagaaactggg

SEQ ID NO: 7021 - DNA, 132 bp, Diabrotica virgifera
  Clone ID: LIB150-044-Q1-E1-E11
accacacgtccgcggacgcgtgggcgaagaagaaggaactaaacaatggcggacgcagctccagccggtggacgtggtggattccgaggaggttttggaggtggtggccgtggaggcggtagaggtggtccc

SEQ ID NO: 7022 - DNA, 233 bp, Diabrotica virgifera
  Clone ID: LIB150-044-Q1-E1-E12
cacgcgtccaatcaatatgtcaccactccatattcataatcacagtcgtagtttaaactgcattgaaattattacatcatgtatgatgacgcagaatatgcacttatcgcctggtttcacaatctagcatgtcgggctgattacctttgaaatgacgctgatcatactgtcgcacctgttatcaacgatagtacttcataattgagtgacattaatgatacccctgtacagga

SEQ ID NO: 7023 - DNA, 390 bp, Diabrotica virgifera
  unsure (1)..(390): unsure at all n locations
  Clone ID: LIB150-044-Q1-E1-E2
acagaaaacgattcagataccgaaccanacactagagtgagatttaatgagcacaaggagaaggaacgagaacgtgcgtttgatacagaagacgcatctagaggtcctcttagtggaataactaggcttgcagactcacccagggtaatgaaaaaaatgcaggaacatgaaagtggcaaaaccaagaaaaaggaagaacccacccctgcccctgtccaacctaaagttgtgccaaaaaggcctcctccgccagccgtaaggcaagttagtgaagatgacgaaatagctagaattaagaaacaaaataaaggggctactacgtcgacggatacaacgacagagacagtgaggcctgctactgaagaaagacagcggaaaacaccagcccct

SEQ ID NO: 7024 - DNA, 456 bp, Diabrotica virgifera
  Clone ID: LIB150-044-Q1-E1-E6
tcgtgggtcgatacaagcctctagagtgagtcataataggtgaagagtagtactgtccaacggagcatgcgcagtgcgaaaaaagcacttgtataaataaaacgaaagtctgcgatcacttcttggctagtgcttgaaatttcagcatggctgacaaaagactatggctgtgttgttttttattattgacaattgcttacgctcaagatgaagatgatgacgattcaggggaaccacagatcgaccagctgtgtgaaaacaggcctgctgatgaatattttaggttaagcactgatggagactgcagagaagttgtaaggtgtacaaaatccggtctaaaacagatcacttgtcccagtggattggcgtttgacatcgataaacagacttgtgactggaagggaaaagtcacaaattgcgataaacttgagaaaccaagaaaagtccctccaattt

SEQ ID NO: 7025 - DNA, 411 bp, Diabrotica virgifera
  Clone ID: LIB150-044-Q1-E1-E7
aaatcgtatctgcgtacaaagtacacacatgtacaagaattcatctgtactcagtagatatatcttaaaaacaccctgtaattatctacgataattactttcagttatttatgtcatcataacaatattacaaccttcattcgattatacaaatattgttatcctagatcacgattcactaataattgcagagtcaattataaccacttttcatggtcgatgctgaataggcatttctaaatatataaacagcaaaactataacaagggaattcttattattatattagacattcgtcattctattttgtgatcagacgtaatatttccacattaaagatagtgtctctttttcttcacgagacgttctttgggtgcggtgcttacagcttatgctcatgcgagtgtaaat

SEQ ID NO: 7026 - DNA, 377 bp, Diabrotica virgifera
  Clone ID: LIB150-044-Q1-E1-E9
gtattatagtggatagtaaggaagtggtggcaaaggtattggtgaaaatggaaatggcggaactggtaatggcaactcaggtgaaggtattgacaactaagatgatgattgtgacgacaaggataacggtaatggcaacggacggcgtggtaacaataatggccgcgacggtattgaagaatagggatctactgacaaaggtgatggagacaagcgaattggtggtaatcgtactggagaacaaggagctggctggcacggtactggtgaaaatggaaatggtggtcaacatagtgctgatacaggtatttccgacgcaggtgaaggtgttggcaactgagatgattgtgattgttatgacaattagtttggtaaca

SEQ ID NO: 7027 - DNA, 258 bp, Diabrotica virgifera
  Clone ID: LIB150-044-Q1-E1-F12
ttctttcacattaagtaatatttctatcagtaaataattttggcaaaatattagctactggcaatattctaattggtggaagaacggggttcataggcaaatcgctttataatctagtaaaatatatatggtgtggggtaactttgatatcacgaatgctaggcattcacaggatatcatgtaacgaattataaatctctagtcttccagatgatatcctatcacttgtgaatctagctggtctcaatgttatggaca

SEQ ID NO: 7028 - DNA, 413 bp, Diabrotica virgifera
  unsure (1)..(413): unsure at all n locations
  Clone ID: LIB150-044-Q1-E1-F2
tcatattacaacactgaaatttaaaaagcatgaattattcatatctgtctgttcatacacataaattctccgtaaacattaataaccaaggttgtaataatggtgagaaatttgaccaagaacttcggattctatacaaaaactccgataaaagctatagattaaattaaagatgggaaagcataaggattcaataaaatcgttttcaacgagaacaacatgaataaaatattggaattatttcatgaaatatacgataccgatcaaattccattggactggttgaagtttatgtacattttgtgacccttcccaagaaaagaaaatttaaagacgtgcagtgataacgttaattagccacaccctttaagtanttttgcttattatataaaacacaattcttggttcaaaaa

SEQ ID NO: 7029 - DNA, 266 bp, Diabrotica virgifera
  Clone ID: LIB150-044-Q1-E1-F3
aaagactcatctactaaccaattacttatctacaagaatgtgactcatgggggagagtctgtatcaactggatatggcaaccccgtctgacaattcgcttctttgaacgtctggcccagatgccccattctagtcgtagatcagagcctagtcgatgaactttcacacttgtaacaaggaaaggagacctgatagagtagtccacgctaaatgatctggtgctttcgagatattttgaatgtactaatgatatcacacagtactca

SEQ ID NO: 7030 - DNA, 448 bp, Diabrotica virgifera
  unsure (1)..(448): unsure at all n locations
  Clone ID: LIB150-044-Q1-E1-F4
atttatacatccacatacttacagtttaaaaggattattatttaattacaacaatagtaaattagttaagaaatgtgttaccgccctgtatgctgttctccttgctccgttatggcttgttatccattatgttatccatgctgtcagccatgttgtccaccatcgtgtccacctaaagaagtccaaaatcgaatcaaactgttggcaccccctagtgagcccaggcctcctttaaaatgtaaacgcattcaaccttgttattattcaaaaccttcagatccaagatccaagactatcaaatttgatgaaaagatgcaaattacaactaactactgcaaagattaatttaatagaagattcccataccacttacttataatattgatgccaagttaggatntgtatcccatcgcanaaatatattatggtactctttctcaaaaccctc

SEQ ID NO: 7031 - DNA, 391 bp, Diabrotica virgifera
  Clone ID: LIB150-044-Q1-E1-F6
atgcataataagatctgcgcaaatgccataccaccatctcatcagatgccgacatgtcatccagttcagacaaaaaggtcatacaggaactataagagtgtctatctttagatctagtatctatagttgtcaaatttcacgattgtattccaggaagtcgtcagtgcatattaggaaaacagcagagtttgtaaaaagatggcataatctgattactctgaataggacgatcaacatatgacgttaaggaaccctctaattacgaggacaccctgtaactacctctacagtataacaaggcaacagcatccacggcagttgcctcatcagtcgtagagtctcatattcataatctagatcgtcattctgaacaacagtagcaacctttcca

SEQ ID NO: 7032 - DNA, 458 bp, Diabrotica virgifera
  unsure (1)..(458): unsure at all n locations
  Clone ID: LIB150-044-Q1-E1-G1
ggtcgaccacgcgtctacactaacgtcctgctaaaaccatgtatccggttttagaatctgtgtgacagcattttggcaaaatactgtcacanagattctaaaaccatgtatccggtttgctcactcattttctttacttagttcctatgaccaagtgtccgtttatgtttgaaccgttaactgtggtaattgaaatatatcgtcaaaggtaaacgttttcctaatattcatcgattttttgtttcaatatttcaacttatttcttattcgcaagtttagaaatattatattatcaatttctatagtttaagataatctataaaatattgttatggaatatccttagctcttttccagttttctttaaatggttctagcatcttagttcccgattataagcagcatattactgcctgtctttttttcgtccacgtttaaatgattcaatagtattttca

SEQ ID NO: 7033 - DNA, 337 bp, Diabrotica virgifera
  Clone ID: LIB150-044-Q1-E1-G11
tctttacctgtgaaatgatgcaacatacacctgcaatttgcaagtatatttatctacagaatgtggaaagacagtttatccgactttactttatagaactatgtagaggatcaaccaaatttagtacatttagaaagttctgcaagcttacaagtgacagtggttgatataatacgttactatcacgactgctgcaatttctatttaggaaatgtgacactggaaaggccataagctgactaagccacgttcatagaatcaacttataatgatagaccctatcttgattactggattactgcataccattagtctcattaattgcctcgtagtccgt

SEQ ID NO: 7034 - DNA, 432 bp, Diabrotica virgifera
  Clone ID: LIB150-044-Q1-E1-G12
ctctaaactgagtcgtattacaacacgtgaattaatattcgaaaatggagtacgaaaatacacaacaaaatataaacttcgtaccgtgtgtaagatgggttaaacgaggagtggccaattcaagcccagtaaaattgcaactgtcgaaaaacgagctggctcaaattattaatgacaccaagattaaattacaagaatccaatgaaaatgaagatgagcctatggaagaaggtgaaacgtctcaaacagatgagtttgccttagaggattacgataaagaagacgaaaatgaggacactgcaaatgctttaggaattggatcattggcagaactggataatgatgctgcagacaatttttctgagtcagacgattctgaaaaagaagatgataaaatcaaaccatctgacaatctcatactagtatgacatg

SEQ ID NO: 7035 - DNA, 396 bp, Diabrotica virgifera
  Clone ID: LIB150-044-Q1-E1-G2
gacccaagcctctagagtcagtcgtaatattgataggaaccctactcgacttcgctctatgtggtatagccgccattgcacgaaaagccttgatgaccggtctgatcactcatcatctgtcagttataattggactgaaagctattaaccacaggcataaggctacacgtaacagatagtatcaaagactgtctatagccactctagctcacactcagtaggacatgaacaacatctcagttatggacattcttcctatggaagaagttttgaagagcttctcctatctttgggaatgcaacctgtatacaaaccagcataagagatacaacatagtctgttttaatttagtgattatttagtaattatttgtgtttaatataacaaagacgtttt

SEQ ID NO: 7036 - DNA, 397 bp, Diabrotica virgifera
  Clone ID: LIB150-044-Q1-E1-G4
atgattattagttagttacgacattagtaaattagttaagaaatgtgttaccgccctgtaagctgtttcccttgctccgttatggcttgttatccattatgttatccatgctgtcagccatgttgtccaccatcatgtccacctaatgaagtccaaaatcgaatcatcctgttggcaccccctagtgagcccaggtctccattaaaatgtaaacgcattcaaccttgttattattcaaaaccttcagatccaagatccaagactatcaattttgatgaagagatgcaaattacaactaactactgcaaagattaatttaatagaagatttccataccacttacctataatagtgatgccaagttaggatttgtatcccatcgcatgaatatattatg

SEQ ID NO: 7037 - DNA, 395 bp, Diabrotica virgifera
  Clone ID: LIB150-044-Q1-E1-G7
aaattgattcatgtcatggcacaacaaaaacacaccattccccaagaattggtttcccaatactttgctatttacacccaaatacttcaattgatccaacacggagatgctgtaccccaagaattgatctaccaacaaagacaaatccaccaacagatcgtactcatgctccaacaattgaaagttgttccccaacaattactcaaccaactcatgtctaacacacaaggccgtatgtggcaaactcaaggaacctaccaaagagtaccaatcatggtgcaaggaacctaccaaagagtaccactcatgatgtaaagactggtttatatttaatatgttgtttaaaatatttattgttatgattgctacaaataaataaatattttttgtatatt

SEQ ID NO: 7038 - DNA, 423 bp, Diabrotica virgifera
  unsure (1)..(423): unsure at all n locations
  Clone ID: LIB150-044-Q1-E1-G8
acttcagactggtattacgtaaagtgtcaaaaaattgtatattttttcttagtagcttcctaaaagtgcttaaattctatcaaactagctttctatcacctaaatacttcatgttactctaatctaagggtacgaggggtacaaaataaatttcacataacctatctgcatagtttttgacatcaccctttaagcaacatggctgcaacaataggacgaatttgtggagctggtcttttaaaaccaacaaacttatcctctgtgggccagttaagttcgtattccacaacaaaagaatggacccgtggaagaaaagcacttttgggaagcttaaggcttattgctggtggtactggtgccttgctgtntgctttggaccaatcagttaaagcatctgatcttgaattgcatccctcanagaat

SEQ ID NO: 7039 - DNA, 171 bp, Diabrotica virgifera
  Clone ID: LIB150-044-Q1-E1-G9
gtgaacattataatttagaagctttacgttcatatgacaaggatcgtaagactcaggctgttcgtaaatcagcaagttgaaaagctcaacgtatacaccttgtccaccatcggctgcgtgaagctcgggttcctcaattggatgtgtcaagaagccacgtcgttaaggtcc

SEQ ID NO: 7040 - DNA, 290 bp, Diabrotica virgifera
  Clone ID: LIB150-044-Q1-E1-H11
cgtccgctcgtcactgatgatgtagattatgccaagaaagcactatcaggtcttaaagataaacaagagggtgaaaagaaggttaaagaagaacaagacaaagccgaaagagaatctaccagtgaagatgaaaagaaagaagatgacgatgatgatgatgaagatgatgatgcagaagaacatgtgccacaagtagaagaaggcaatcacgatgatttataaaaatagtgtaaagtgaactaaagagacttttttaaaaaataacagttttaaattgtttggtccaaaat

SEQ ID NO: 7041 - DNA, 323 bp, Diabrotica virgifera
  Clone ID: LIB150-044-Q1-E1-H12
gtcgtatcatatacattttgtctactaggtactacatccatgggcgtatgtctcactttatgctttgtcattatttatttgtatatattactattttcatgggataagttatagcggttgaactataaattggggcgtttaaaatgtgccccttttggtcatattagtaatcgtaccttgtataataatctcaaatgtattggtttaagcatctgaattcggcaacattgtttccacctgtatactactaacatgtcttttcgtattaaatatgttttcgcgccagaccactgcatacatcgtatggctgcggtattttgccc

SEQ ID NO: 7042 - DNA, 468 bp, Diabrotica virgifera
  unsure (1)..(468): unsure at all n locations
  Clone ID: LIB150-044-Q1-E1-H2
ccacgcgtccgaccaagcgtccggcgcagcgcanagttaagatctagccgttctttctatttttgaatctgtgcttctgaactttttcttccattaaaaaaaccgcaaaaaatggcaaaattggtgattttgttggcatgtgttgctgtatttaatgccgtaagcgcacttgattgctacacttgcaccgacgatgcctgcaaaaaagatataaaagaaatgcaaaaagttacgtgtggtaaacccgctgaccaaaatcaagaatccgtttgccaaaaagtaacatacaaaggcaaggatggcaaggaacacatcgaaagaaaatgtgcctatgctcccaagaacggagaggctcagtgtcncgcatccataaacaaagctgatgtaactgacctaaaatgcccatcctgtaaagctgatctttgcaactcagcntacaacatcaacttcagcctaacagcaatcgct

SEQ ID NO: 7043 - DNA, 472 bp, Diabrotica virgifera
  unsure (1)..(472): unsure at all n locations
  Clone ID: LIB150-044-Q1-E1-H4
gggccggccacgcgtccgattaagtcggagttaaacgaaccgacatacagttgagtcggcaaaccttaacccgtgcgtcaccatttagagcaggcaaaataagtcaatgatagtaaatttcaatttcggacttaccaccaacttgttccgaaggctttgaaggataacgcacggttggggttccgcggactcaactgtactcaaaatcccttaaaaaggcaatgtatgatacaacttaaatccgtgtaaaaaaattgctagggttacaatttaaataattttgaacaattggtaaaaggggacacatgcnattattataaaagcttttattgttataaaacttgataagtcagtgatttgttactaaatgaggcgacaatatggctgtataaaagcagaatccttgggtttttcgaatttacatttattgaattttactaatatcagagaatcactttgtatgcaatcagac

SEQ ID NO: 7044 - DNA, 417 bp, Diabrotica virgifera
  Clone ID: LIB150-044-Q1-E1-H7
acgatcatcatgaaggccttgattgtccttagcgtttgcttttgcttaactctagctgccgaatccgagaaaaaggaagtaacgcaggagagtaaaaaacaagagaaacgcggtctttacggccttggtgatcatggtggaggattcggcctaggcggccacgattttggaggcggccatgattttggaggcggtgattacggaggtcatcaagaacaccacgaacacgtaaaaacggtcgtagttgaaaagaaaattccaactccttacgaagtagtcaagcatgtgccttacaccgtagaaaagaaagtaccatacgaggtcaaagtaccagtaccacaaccttacgaggtgtacaaaaaagtaccatatccagtaaaggaaattattaaggtgccctgtatcgttacacaaccg

SEQ ID NO: 7045 - DNA, 386 bp, Diabrotica virgifera
  unsure (1)..(386): unsure at all n locations
  Clone ID: LIB150-044-Q1-E1-H8
accacgcgtccgaaaaatcgataaaggttttaaccagctacagtcaattacaaaaactacaacataaagtaatatagctataataatatgtgcgtataatagaaaacaaccacaatgacaaatcttcaagaagtaccaacagacgaattattgtcattccaagattttcctagtgttcacatctccggtgatgacaacagaaccataccaatttcagaggctcagatcaatgtaaattatgtaaatggaaatataagcccaagtcacaatccccctgggccaggagatgctccagtcactgatggaacaaatcccacancagaaaaagcattttggactttagaatattaccaaaagtactttgatgtagacacgtcagatgttgt

SEQ ID NO: 7046 - DNA, 374 bp, Diabrotica virgifera
  Clone ID: LIB150-044-Q1-E1-H9
ggtgaaaatgtatttataatttacatttttaggtatattttacaaaagaagcaacatctcgatacactgtgatttatcaattcaatactacgaggcaaaaagtttcaaagtcactgtgtttatctaatggtcgcacaataatagtttaattggaacgtacgcaaacatttggggggtttaaagttcacaggaataaaacacgcataacatttctatgtaaatatattaaacgcgaaactacatctctataaaaactcgcgtatcgacaaaatactaagagccaacacagttttatcaacattgtgttgacccaatggtatcacaataattacttaactggaatgtccacaaacgttttacggggtttaaaggat

SEQ ID NO: 7047 - DNA, 373 bp, Diabrotica virgifera
  Clone ID: LIB150-045-Q1-E1-A10
taaaatgattcgactaaaagacataaaaaatagacagatctgatgttttcgaaatccctaatatttcgtacagttgttcacataaacatctttttggaaaaataatagagtaattaatagaaatacggaccgttttgtagctgttttaagaaatccttatcgacaaaacaccattcaactctcatttcgtcctgacaattgttttaaatgtattgaggattaaggattttttaattatatacaggttcgtttccttctggttaggttttttcgttaatttaggtttcacattacgtaaaaatggtgctaacacacaaaaagagtttcgaaagaggggcagatatatttaaaacaatttaccaaggtgcagggg

SEQ ID NO: 7048 - DNA, 434 bp, Diabrotica virgifera
  Clone ID: LIB150-045-Q1-E1-A11
gtcgatacaagcctctaaaatgagtcgtattattattgtaaaataaatattttaaataatttttttgtaatgaaatgtttttcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttagtatttatttttatatattattatgtttattttttagaaattttttagtaaaatataaatttaaattatttaaatttagtaatgatgataatattagtattaaaaaattgtagatttagtaaaaatatataggtttaataaaggaattcggcaacatttttt

SEQ ID NO: 7049 - DNA, 289 bp, Diabrotica virgifera
  unsure (1)..(289): unsure at all n locations
  Clone ID: LIB150-045-Q1-E1-A12
atagtgagtcgtattaaaccngtggngtcgacattctatgtcgttttctgaactctcacaagtcacgtctttggccatagcttaatctttaaggtctactattttagggtgtaggagctttacaggtatgtattatagctgtttataagaatccttggcggcagatctcgggacgaccctcagtgcaacctttcatttattctacctgtatttcggagtagtgatattgtaagtctctacaagttcgcttccatctggagtcatttattcatctccttaggtttcacat

SEQ ID NO: 7050 - DNA, 410 bp, Diabrotica virgifera
  Clone ID: LIB150-045-Q1-E1-A5
cccacgcgtccgtgttaatgtaaaagaaagctcagataaaaaggtagtgttaaataatttgcaaaaggaacttacaggaaactatacctgtgaggccagttggacgacatcaagcaccgtgactgctaaggattcgaaagaaatgtatgtaatggacgaattaaaaggtgatattctcctagaaggtacatctccccttcgtagtacggataagttgtttggagtatgtgttagccctgcatctcaagttaccccaaaatttacatggcttttaaatggagaacaggtttctagtgaggagtctcaaccagccaccaaaaataataaagatccgaaccgttttatcgcttacctaaaatggacgaatggagtttcgttcgtagatggtaaggccaacctaacttgtgttg

SEQ ID NO: 7051 - DNA, 394 bp, Diabrotica virgifera
  Clone ID: LIB150-045-Q1-E1-A6
taatgtgaaagaaagctcagataaaaaggtagtgttaaataatttgcaaaaggaacttacaggaaactatacctgtgaggccagttggacgacatcaagcaccgtgactgctacggattcgaaagaaatgtatgtaagggacgaattaataggtgatattctcctagaaggtacatctccccttcgtagtagggataagttggttggagtatgtgttagccctgcaactcaagttaccccagagtttacatggctttgaagtggacaacaggtttctagtgaggagtctcaaccagccactaagtaataataatacatccgaacccgttttaacgcattacctaagcatgggcgaaatgcgagtttcgtttcgtacactcgtcaaagccaaccc

SEQ ID NO: 7052 - DNA, 142 bp, Diabrotica virgifera
  Clone ID: LIB150-045-Q1-E1-A7
aaatagatgcaggcttgccagtatctttaccttttggcataccctataccagtcctgtttttgtgacggtacgcgccggtacgccgtaccggcaccttttgggacaaaaaataaaaaaaaaacaacaaaattataaacaaaa

SEQ ID NO: 7053 - DNA, 376 bp, Diabrotica virgifera
  Clone ID: LIB150-045-Q1-E1-A9
gttacctaaacaactaaatattttcattttatttaagataaaattatgaattaattaacttaatatcgaaataaaaatgcagtccaatattatacaaaatagtatcgagcttcctccagaagttactgttaaacctttggccttagtaggcgtatctggtctagatatagttaataatgcagtccataaatccatttgggagactttcagcagtaacagaaggatagaaagggctcctgttttatttaaattaattgataacgctcacgaattccctgtgatcaaaccaagaagaacttcgtacgactggtacattccaaaaggtattcttaagaaaaattggatgaacaagcatctctatgaggtgcctgccgtt

SEQ ID NO: 7054 - DNA, 124 bp, Diabrotica virgifera
  Clone ID: LIB150-045-Q1-E1-B12
atagtgagtcgtattaaacggtggacagtcaggttaagggagccgaagctctaagcccatacgtagtggtacaccttttggtatttgagtttgggtgattagcttgtcggtaatgggtcagatt

SEQ ID NO: 7055 - DNA, 265 bp, Diabrotica virgifera
  Clone ID: LIB150-045-Q1-E1-B5
cggacgcgtgggcggacgcgtgggtatagttgtacatttatttatttttttgattgccgtaaataagttcaacatcctcgcccgggcgaagtatagactatatttttgtcattcggagactgcgaatattgctgtttctttgtcgagttcatgtagagttaatcattttgagttgtgcggatcgcaaatgtaccgttgttatatttggttaaatgtaactaaaatattctttaaacattgtatcatcatttcactgatggttaat

SEQ ID NO: 7056 - DNA, 169 bp, Diabrotica virgifera
  Clone ID: LIB150-045-Q1-E1-B8
gtgagtcgtattaaacttttttattagtatatcaatttaaagtatttaggtttagtaatgatgataatatcagtagtagacggttgtagatttagtgaagatatacaggtttactaaaggaattcggacacattttctttcacctgtttatgagaaacatgtcgttgtg

SEQ ID NO: 7057 - DNA, 395 bp, Diabrotica virgifera
  unsure (1)..(395): unsure at all n locations
  Clone ID: LIB150-045-Q1-E1-B9
ctttgtgcagtacttgtagtgtgacataatgttgacgaaggtgacagtattaatagtattagtggcatcaacgcaagctggactcttaggcgctccagctgcatattcaacagtcacttcccacggggtcctaggtggccacgccctagcagccccagcagtttcatacgcatccccagcagtgtcatacgcagcgccagcagtctcatacgcgtctcccgccgtttcctacgcagccgccgctccagctttatcctacgctgcacctgcaatcgccgcaccagcgatagctcatacgtacgctgcgccgacaattgttaaagctgctcccgtgatcaaagctgcaccttctgtggattatgtancgtatcccaaataccaattcaactatggtg

SEQ ID NO: 7058 - DNA, 431 bp, Diabrotica virgifera
  Clone ID: LIB150-045-Q1-E1-C1
cgaaagactacagaaccataaaatatttgctgattctttcgatcgatttgtgattgtctcgttcctcttagatcttcctcgtttttatatcacctttttagttttttatatgagtttatttgtgaaacaatggaaaaaaatgatggtttgttttaatttttgaagtttcgcctgcatctgggcgtcttctcaaattgagtacttcgttcttcggtttctagactatttgtaaaatatttgttgctcaaaaaatattaattctgtattattttaactataagtaatcctataagtcttactggacaatgctctaatgaataaaaaaactgtatatttaatatatgagtgtgactcgtgtgcgtgtgctgaattgttttctaattcttaagtctgatagttaattgatgaaaaagtgttatttaataattaag

SEQ ID NO: 7059 - DNA, 401 bp, Diabrotica virgifera
  Clone ID: LIB150-045-Q1-E1-C10
tttagcatttacacctcgtaactcttggtacgatagcacacggtaatcttttagtgaaaagatgaacaaaatcaattatactgttttaaaaaatgataagattggaagatacttggttgcctcaagagacattaaagggggggaagttattatttccgaaaaaccattactaattggaccacccatttcgggattattaatatgtttcaattgctgcaaagaaattaaaagaattgcgtatgtactttgtgcatcttgtggtacagcaatattatgcaatgccaaatgtacaggtaaatttcacaccaaagaagaatgcgaaatttttgcatcaaaacaaattaatggacgatgtattgcagacaattgtcaaattatctttcctctaaggtgcttaatac

SEQ ID NO: 7060 - DNA, 118 bp, Diabrotica virgifera
  Clone ID: LIB150-045-Q1-E1-C4
cgaactcaaacataccgtccaaatcctgcatggaagaacaagagcgcgtggtcaagatcgaagctatcaagaagagtctggaaatagaagtcaagaacctctcagtccgtttgccgaa

SEQ ID NO: 7061 - DNA, 409 bp, Diabrotica virgifera
  Clone ID: LIB150-045-Q1-E1-C6
cacgctcctcgagcacgccgccttctcagcagcagcctcaaattaacacggcaaacgccggaggagtaccgcatatagtatctgttaacgcaggacgaggtcggccagcaagcgtagaagtagaacatccatctgcggcgatgcagtctcaaccttgtaacgattttattgtaccttgtccgaatcctggaatccaggcagtcactcgaagacagaggctacctccaggtgtcgtttatggtgacgtcagcgtagaatctccaatccagaattacacaataatcggcggcgatggcaacgtgatggtcgaccatcccggcgcagccatgcagagccaactaatttctcaacagcaacaggaacaaccctcgcaagctccacctttggtccagaagcctgtgacgaaccc

SEQ ID NO: 7062 - DNA, 385 bp, Diabrotica virgifera
  Clone ID: LIB150-045-Q1-E1-D10
aacatttttgcaacaatgttctcgaaaaaatatctgacttttctgtcggtattgtgtatagctattgccgtgttcgcggacgacgaaatacctgaacctaagccaaaaagtgaatacaaaaaatctttgtcaagagattgtgcaactagttattcgacgacatgtttaaaattggacatagtgtcatgggtcgataagttaaacgaggaaaataattatagtgttctaccgggagtttcggtgataaaggaagagcaaagtgataaaagttcgacggcagatatggtgtctgaattagcacgagactttcccaatgatcccgacgcccgcctggacgcgttcctcttgaaaaaagtgacttcttatttaaacagtcattccttac

SEQ ID NO: 7063 - DNA, 411 bp, Diabrotica virgifera
  Clone ID: LIB150-045-Q1-E1-D12
ttgagatttatgttgatatgtgatctgaaggaaccactacactgtaaagataccctagtaagagtggaatcagttcagtgagtcaaattcagtttcgcagaagtcgattaacaaatttaagctcaaatgttttcactttggaaacaaagtttggtgtatttgatttacgctagtcatttgatggaaaacaggatttttttagtcactgttatcgttgaattcagaattcacattacagattttagaatctacgctgcaacaataatcgacgtacctttttgcgcatttaatcgttagttttagcttggaatgtattataggaatcgtttctgagctgagaatcaatgtcacgtaatcggatcacacaaaggaacataaaagttggattcaactctaaacaaatgttttttt

SEQ ID NO: 7064 - DNA, 430 bp, Diabrotica virgifera
  unsure (1)..(430): unsure at all n locations
  Clone ID: LIB150-045-Q1-E1-D4
cccacgcgtcncgtaattaaanataaagaatacttaagaaacatatacatgttcgaaattgaaatcgtgttggatctataagacgaaacactcaaattcatggacatctcgaaaactagcagttcgcactactatttatagtaaaacaagtgattgtttttcaattcttgattttttttagaaaaatttttattgaaattgtgtgtaacatctagttttgatttttattaggtatgaataagaattacttcgaaatttgacagcaatttttttagtaaaattaaataaataaatttggatttgactatcaaaaagaaattcttaatcatgttacataggctacaatataattagtcaatctgaagaaacctaacaatctataaaaaaatacttcaacgaaataataattgaatttggtttgaataaaaat

SEQ ID NO: 7065 - DNA, 427 bp, Diabrotica virgifera
  unsure (1)..(427): unsure at all n locations
  Clone ID: LIB150-045-Q1-E1-D8
gtcacttgcgtactgctggcatattactgcgtagtattaattctaagcggtagtgttttttcgttcatacattgttaataattacattattaatactaatttactataaatatgtcttatagtacgcgaagaagtactggatataataccccacaaacccagaacgtgggaaatgtcggccaacggagaccggtggttacaaataattttgtccaaggacaacaaaaaccaccacagcagcagcagcagcagcaggtacaacaaaataaaccaacaacaccagctactgcaagaccacaggctacaactccacaggcaggaattcagttcagggctcagcaacagacaccacaagcanatcaacaagctgcgaacacacaagcagcagcanatgctgcaagactacaacagcaggcacaagcacaac

SEQ ID NO: 7066 - DNA, 178 bp, Diabrotica virgifera
  Clone ID: LIB150-045-Q1-E1-D9
aatcgctgtgaatgtgtgtgcggtttccataatatagaacgataaatttatggataacatctttttttgataagctaaggggcgacaatgggggaagggaagagaatggcagttgacaatggtggtctttcttccaacaagtcttccactatgtagccgtggtagtggaagcaccacg

SEQ ID NO: 7067 - DNA, 298 bp, Diabrotica virgifera
  Clone ID: LIB150-045-Q1-E1-E1
accacgcgtccgcggacgcgtgggtttgaacttcaacagaaagtattgcgcacagcagagaactaacgtaggtcctaaccaatagttgtggcagagaatagttatcggatgttttccttaatgtagcaatttagttaaagactacactacattatccatttacatactagttatcacacattagaacagcatcattatgggttactcactcctagcggagtgtttaccgctccttccaattgtaaagtgttaacttctttatgtctccgaaatattgatctccatcttgttttgggtc

SEQ ID NO: 7068 - DNA, 399 bp, Diabrotica virgifera
  Clone ID: LIB150-045-Q1-E1-E10
ctccaagatgaaggtactcattcttctttccgttgttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacg

SEQ ID NO: 7069 - DNA, 428 bp, Diabrotica virgifera
  unsure (1)..(428): unsure at all n locations
  Clone ID: LIB150-045-Q1-E1-E2
gttttatggctaaatctgagaaacanagtataaataacatagcgttctattggttaaataaatcatgagaacttcctcaattataacctcaaaaaattcatgaaagtcagatgacgataaccaaggagctgtcatgcgtctgcgcgaagaactaaaatgtttgacgcgccgtcaccaaaatggaacatggagaacaaaggattttcgcggagtgaccctactgattatttagcattatactaatctcaaatacattacgtttgttctaacatcaatttcaagcggtttgaaatcatcagaagcatgcgcatttgtttgatagcgtttaagcacacatattactagtttgaaactactagtccagcgttctaactttgatttggaaactagctttaaacggtcaaaaaggtttgcggattttgttctga

SEQ ID NO: 7070 - DNA, 338 bp, Diabrotica virgifera
  unsure (1)..(338): unsure at all n locations
  Clone ID: LIB150-045-Q1-E1-E3
gtccacacacccgtctagaataatctctcatattctgcgttgggcatgtcaatattgtttttgattatacacattatggcgagaagcgtatcctggatatctaataggctacctactcttattactaagtttcttcgtaccattaggtattangttactaccagaagaagtaacctcgaaaatagccaacggaattaaatatacatttaacgtaaaaggtacattanccgaacaagaattggttccttttatctgcgacacagattttaatactaaggatgctgatttggacagtctaagtactgatagaactgcagattcagtttcaaattcgctta

SEQ ID NO: 7071 - DNA, 426 bp, Diabrotica virgifera
  Clone ID: LIB150-045-Q1-E1-E5
gaaataaagttattgaatgaacatggccaaattcgctaaataatctaaatacatactcacatggtcatggtgtgttgtaggtattacttagttgatataagccaggatttgtgattgttttgtttctgttttgttctcgaattttatgttggttatgtaaaagaaagaggaaagaccataggaaatgattaccgtacgtagtttagcaactaaaatggggagtgacataaaggcgttaaaaacagctttgcggaaagagatcgaaggaaaattaggacaacttactccacaagaaagacagagacaatcccaaatagtaaaggaaaagttgtttggtctagaccaatttaaagacgcaaggaatatatctatttatcttagtcttgatactgaaatagacaccgaaccaattgttaggaaaatctt

SEQ ID NO: 7072 - DNA, 429 bp, Diabrotica virgifera
  unsure (1)..(429): unsure at all n locations
  Clone ID: LIB150-045-Q1-E1-E6
aaatagattccatgataaacaaaaagaatgtaattttatgagtcatttaaaaaaatttaccatgggtactatcaaaaatgtgatagttgtaattttaactgtacaaatattcattgtaagatgtagcgacattacaaaacttgcttttggacaatttactcatggacttccagcagcatttggagactttaactctgatgaacttacggatgtgtttgtgttaactaatagggaacaaacactccaaattcttttagcttatgcagaagagccattgcttcgaccagcacctacacttaattgcacatttaaaaaccacaagattaccagtgttgtaccaggtgattttgatggagatgccttgatggatgtgttaataactactattanagcagatacctcgattaacaatgcaaggacaagtattta

SEQ ID NO: 7073 - DNA, 422 bp, Diabrotica virgifera
  Clone ID: LIB150-045-Q1-E1-E7
aataaatgtcagattcaacaaacttgttttgttacctagcaacgatctcacaggttacttaaaataattcatcttatcacataatgaaaatggatacagatatttgaaacgaaattattattggtagattgtgagtattagaaatccataaactactaaccgattgtgagtaaaatagtatacaaacctcgcgggaactcattctagcctcgcgtctgtagtttacctcggtgcttcgcacctcggtaaactaaccttgccgctcggctgaaattatattattttccgggtaggtaggtaatatactaataacttccttcctggctcagataattttcgcaatttatagattcgcaatagatttattatacccattataaaatttaaaagaccaaatttcagtatttaaaacgtaagtatat

SEQ ID NO: 7074 - DNA, 369 bp, Diabrotica virgifera
  Clone ID: LIB150-045-Q1-E1-E9
ccacgcgtccgttttaattatcattaacaaactcattggaggtttctaatattaagggtaattaatttactataataaacgtatctatgagttatcaacaaataaactggaatatctcgaaaagtagtcactttgggtatagggagtgtttaggagatatgcgggtgtagtgagagaacttttcgatggtaatatgaagtacagggtgttccatttaaaaatatgaagagggtcttttatttgcattttgacttaccctgtatacaatttgcgtagtggtaggaaaattgtacgttgttgcaaagctactttagtgttgacggtcaacagcagtgaaaaaataagtttatattgtactgttggagtcat

SEQ ID NO: 7075 - DNA, 74 bp, Diabrotica virgifera
  Clone ID: LIB150-045-Q1-E1-F1
acaacatccctgaagtgagtcgtattattaaggagaatatgagaatagattagaatatagttggatcatattat

SEQ ID NO: 7076 - DNA, 387 bp, Diabrotica virgifera
  Clone ID: LIB150-045-Q1-E1-F12
tacacatgcgtctgagaaaacaacagaccagtccagatcgcaagtgcccgggttctcaaagttcgaagagaaaaagagacaacaaacagataagaagaacaagtatctaaagagcttacctgtctttagaaagtcgtcaaatgtaaaagatgctggaagacctgaaaaatacatcgacatcatgaggcagaccaacccggacgccaacaaattgatggttgaattcatatcaatgtacagccaatggggcgagctagtcagaaaagacttcttcaaatttagccaagtgttttccaacaaaatagtaaacgaactggacgtcaagcccattgaagagttagcggaaatcgcacagaatcactacaatttgtatcacaaccgcgtcaa

SEQ ID NO: 7077 - DNA, 356 bp, Diabrotica virgifera
  Clone ID: LIB150-045-Q1-E1-F2
cagacacgtgggatgacgctgtcggttttcttttctgtgcatgtttcaccatttttaataatttaaaaacccgctattcgtaattatgtaggatgtctttacggattacttacaattttggacataaaatgactcccggccgatcatcaacgactacagaagtgtttgtaggaagtttgcctccagacgctaccccagatgatttgaagaaacttttcgagccctactggaacattgcataatgcgacatcgcgaacaaatgtggattcctccacttggatgatggcgaattggcaatgaatgccattgaagagctaaatggtatggaatttatgggttccaaatttcagttgaaa

SEQ ID NO: 7078 - DNA, 386 bp, Diabrotica virgifera
  Clone ID: LIB150-045-Q1-E1-F3
cacgcgtccgaagacacgtgtgatagagctgtcggttttcgattctgtgcatgattcaccatttttaataatttaaaaacccgatattcgtaattatgtaggatgtctttacggattacttacaattttggaaataaaatgactcgcggccgatcatcaacgactacagaagtgtttgtaggaagtttgcctccagactctaccccagaggatttgaagaaacttttccagccctactggaacattgcataatgctacatcgcgaacaaatgtggattcctccacttggaggatggagaattggcaatgaaggccattgaagaaccaaatggtatggaatttatgggttccaaaatttcagtggaaaatgggcaagttaaacttcc

SEQ ID NO: 7079 - DNA, 413 bp, Diabrotica virgifera
  unsure (1)..(413): unsure at all n locations
  Clone ID: LIB150-045-Q1-E1-F6
gaatacttaaatttaagactctatgacgaattattaaataatataagggtttgtttcccatatcttacagctatacttctagttctgtcccatagcgtcctactatccagttattaagggtttttatctctctatgtcagctcatactggtgccgatattcacctgatcttccacttctgttttgagatttccgcagctagatagtgtaattcctagatatttacttcatcacttattctattatctgaccctccagctccaataaaccgccagctacgacaaagatcaggagtggctgatgcagtagagggaatagcanaactgaaatggaaacgggcaggtcacgtggctcgaatgacagataacagatggacaaagtggatactggaagagagaccaccaggagatgatg

SEQ ID NO: 7080 - DNA, 428 bp, Diabrotica virgifera
  Clone ID: LIB150-045-Q1-E1-F7
cggcgttaatcagtttgttgtttattcgggcacaatgcctttcgtgccatcagaaagtttgtctaaaatgtcatggccgagcaatgaaagtatccatgccggtagttcgtccagtggttacgcaggaagctgctccagtggttctggattccaaagcccttcttcgccgacgtctttctcgccaatttcttcctctccagatgccacactgagaaaaaggttcagacgagcttccagtctaggaagtgttattcaagaaacctttcgtcattcgctctgacgtacgagactcaagaagtcagagcccggctttaagttgtcacgaagaagaagaagatgagtttgtctactcattactctcaaaacttattggttggtatccttgcttcttgctgcgactgatgaaagctctcttcatcgcagtgctt

SEQ ID NO: 7081 - DNA, 428 bp, Diabrotica virgifera
  Clone ID: LIB150-045-Q1-E1-F8
cccacgcgtccgcccacgcgtccgatttattttaaaataataaaatattttttagtaaaagtaaagaaaagttttatttaatgataggtaattagtaatgtgagagaatattttatttttataaaagaaagatttatgtgttgtaccgtgtgtatcagggattattaattaataattatatagttattattttcgaatttaaaagagctattaaattaggatttttattgtaaaataaatattttagataagttttgtgtaacgaaatgttattcgtctttaaatatatctaattttttaagaaatacattaaatttacttattaacaatatatatataaataaatatttttataacaataatattagatatttttacggatgagcttacaggtaaaattaaattagaatttaatttttagataaaaa

SEQ ID NO: 7082 - DNA, 312 bp, Diabrotica virgifera
  unsure (1)..(312): unsure at all n locations
  Clone ID: LIB150-045-Q1-E1-G10
atagtgagtcgtattatacctgtcnngtgngctgtggtcgtgcgtggtgtggtttctgtgtgtgcgtgatcttgcggctcttgtcgttgtcgctgtctgcgttgtgtggcgggctggcttcgccggcgatgtcgcaccgggtgccgtcgtcccctcaagcgtcgggcgcccagtgcccgtgggtctcctggctggtaggggacacagagccgcatgtgtgtgtccatgcatcccatatgaataccggtggcctcatattgaagttctgcactgtagcaggttccatgacgtactgtgctgagatcgttttgt

SEQ ID NO: 7083 - DNA, 392 bp, Diabrotica virgifera
  Clone ID: LIB150-045-Q1-E1-G11
ctctacaatgagtcgtagtatatttcggtgtatttttgtacccaataacaattgttttaagcgggtcggttgatgtcttttttccaggcgtactgttgactgatttagatgtagggtactgtgcttttcgttttattttttgttatgcggacgttgtttttgactttatgtcgttttggaagcaagctccacaatcgatctcgcatttgtaaatatcctgtaaaaattgctcatgtaaaaattgtttttgttaatatgtactgtttatcaagaaagaaacgatagatcattgcaagttttgaaacacgtctaccttttttggcatatacagaccaaggggtcagtttagcgtcaaaatttataagcatcttacgtgaaaaagttcgatcgat

SEQ ID NO: 7084 - DNA, 283 bp, Diabrotica virgifera
  Clone ID: LIB150-045-Q1-E1-G2
agactcttgggacttaattttcgtgtgatttttctgtgaaattataacaaataacactggcaccaaacacgtcaatgcccaccggtgttcttcatgaacacgatgactaagtccaagcacagatgattcccgcggaaattgttaaaccaagcgagcgcaaacttgaactggtttggcgcatcatcattcgttatgcttatcttcacatggtagcgctgtatggattttatctgatgatagcacaggcgaaagtatttacttcgatattggctgtagtgttata

SEQ ID NO: 7085 - DNA, 426 bp, Diabrotica virgifera
  Clone ID: LIB150-045-Q1-E1-G5
cccacgcgtccgcggacgcgtgggtgcatttttgcattgtgatgattgtattttagcagtaatttatggagttcaaagcatatacttctgttttccggcacagttagtaacgttaactaataaagttaaaatagcgatattgcttgaagtaaagtagttcccattttggtctttttttatatcttcttttattaagcaaagcaatagtaatgtgtaggtaacaacgggacaaaataggagctacttatttcacctttttttttataatgtcatgtagtttattttttggtaagcggtcgcaggctccaatgaggattacagctaagacattcatttgcaatcataaaatcatttatgacgataattattatattaatttaattctggttttacatccatttttgcttaagctttttggtattttgt

SEQ ID NO: 7086 - DNA, 425 bp, Diabrotica virgifera
  unsure (1)..(425): unsure at all n locations
  Clone ID: LIB150-045-Q1-E1-G7
tgtaaaaagtttatgctctgcagagattggttcctattttaactggaagtatttctttgttttttttttattttaaaaagaataaaattcagtgaatctatttaagctaatacattagtgtttttaagacaaacaatatgttcaaatagtagatgtcagaaatttttttgatgttttgatggttacaatctgagtcgtgtggtcctgaaacttatttcttgtgaatttttatatcaactactgtattttgtttccaatttgtttgaaattgttcccaaaataccaatcaaacaaatcattattactcgaaaatagaaaaaaaatccttatagtttaattttatggtttaactcatccagttttcttcatgccattattttgttccatattttactaanatgaagataaaggaacaatagtcctgc

SEQ ID NO: 7087 - DNA, 239 bp, Diabrotica virgifera
  Clone ID: LIB150-045-Q1-E1-H11
agcatacttcaggtaacacaacaccactaccattaacattgataacataccgatcttaattctacatccaaaacaacaccgtggaccaggttgtgcttaactccgcaaacacatacttggttatgccaaaatggttattaaacggacaacagatgatctcacccattctcataacaattcaatttaccacaatatgttagattcaaatgtacatgaaagatatcattatgttaaccata

SEQ ID NO: 7088 - DNA, 425 bp, Diabrotica virgifera
  Clone ID: LIB150-045-Q1-E1-H5
aagacgcgtgggcggacgcgtgggaatagattcctagttgtgttatcgttttcttttttaaacaattttgttttcatgttgaattaaacataattattaagtaatatctttgccgaaaatgcctcttcctgcatcatacactccaaactacttctcaatggaagatatattagctactcaagaaagaacaccatgtaaaattgttcagactattccaaatatgggtcatttaaattcatctgctgctgaaaaagatctccaaccagggacctcccatgagtttcctttgtggttagtaagtgaaatttcatttagtcgtcaaccgctagtacagcctgatttacccaaaatatacaaagaagcatatagagaaattttaaaagctgatgcctgtgcagtagaccttcacaaattcaatctgtatt

SEQ ID NO: 7089 - DNA, 58 bp, Diabrotica virgifera
  Clone ID: LIB150-045-Q1-E1-H6
atgcataattatggagtaacatccttgcctatcacggttcatcctgtagcattaactc

SEQ ID NO: 7090 - DNA, 144 bp, Diabrotica virgifera
  Clone ID: LIB150-045-Q1-E1-H7
agcgaattcgcgataaaaaaaaaaaaaaaaaaaaaaaaaaaaaaaaaaaaaaacaaaaaaaaaaaaaattaaaaaaaaaaaataaaataaaaaataagtatataaataaaatcaatgaaaaaaaatgcctcatcgggcaggccg

SEQ ID NO: 7091 - DNA, 276 bp, Diabrotica virgifera
  unsure (1)..(276): unsure at all n locations
  Clone ID: LIB150-045-Q1-E1-H8
tgagtcgtattaaacttgggntcttctctgccgggctcgtatgggtggttctgccgctggtatcagggtccagctgtgccctgatcaggaagtacccgtggacctagtgcacaggcgtggtcatgttgtgcagcagctagcagagctgcatgaagatgttaagcctagccttcggattatggagtctgaagaagttatgaataatatggaagccatgagagattcgcatgcacttattacatatttgtcactgtgagtcgggtttgaccttgaatt

SEQ ID NO: 7092 - DNA, 433 bp, Diabrotica virgifera
  Clone ID: LIB150-045-Q1-E1-H9
actcgcaggtcgatacaagcctctagattgactcgtaataagtatgaaaatgtaaaagataacaacattttgaaacgaattcctgatatgctcaagaagcataacagtggaatatgggaatggcagctccagttggactactctcaaagatataacgaacagttgcctgaggattagctgaaaattccccctcatttccaagcaagaagtcaaccttggaagaactgactgccaaataaggaaagagcaaacgtctatttttagggaacgataacgacattttgaaacgaattcctgatatgctcaagaatgctcaaaatgtattcctttttgtactttttgataaatataaactgaatttttcctctgacatgtatattgtctaaataaaagcgtaaagtgaaaaatgttttacatttttagtaattttaat

SEQ ID NO: 7093 - DNA, 314 bp, Diabrotica virgifera
  Clone ID: LIB150-046-Q1-E1-A12
cgtcctgttaacgcgtccgaccaagcgtctggctgaagttatgaggtacttttattcactgatagtaggttactacagggagagaatattgaacttattcagaaaatagatcgagtgtctggaccgagtgcatcagggatgacgagtaaatagtggcggagccaggagttacgtattgggggtgcatacagaacgttaacatctattgtgacctggagaccctatatccgtatgttgtattgataggtgtgtccgcattttgttatatcgaagtgaccatatcacatattacatttacttatgtacaatattga

SEQ ID NO: 7094 - DNA, 353 bp, Diabrotica virgifera
  Clone ID: LIB150-046-Q1-E1-A3
ctgaatacgctctatcgatattcactttgacactgacgttagtaatttctttttttaaaagttcagttgtcagaagtgactggaaattactacaaaaccaacgcacctgctcatagccaatattattaatagtaaacagacataaaaataacaagcatcttacgccaatcaataattatttatttgcaccattataatgtattaataacaactgagaaaattatttattgtacaaaataaaaatattttgtagaaataaacttcacaaaattttatgagattagtagacactcccactatttctaataattcttcttttttaatgaaagattaaagttgatttcagttgattt

SEQ ID NO: 7095 - DNA, 376 bp, Diabrotica virgifera
  Clone ID: LIB150-046-Q1-E1-A4
agtctggagaaaagaaatcatcctccgagtcctcctcgagcgagaaagaatccagcgaactaaaaatccaagaaaagaaacttgcagaacctctcacatctatcaaagagccaattaaggaagaagtgaggccaatcgatccacatcatgttttgaaaccacctgaaccagctcaaccagatgttttaccacaagaacctaaactaatagatgccgtagtgccacaagattgctgctaaagcgatctcagccgaaccagaagagaaacctctagctctgccaactctaggtgcagatgaaaaaccagctgagcaagctcgaaaattggtcgccactgaaataataagagacaatatcctactcagtgaacaaaaag

SEQ ID NO: 7096 - DNA, 389 bp, Diabrotica virgifera
  Clone ID: LIB150-046-Q1-E1-A5
tgggtcgatacaagactctagaatgagtcgtaataaacacggcaaatagtaacgtgcgttttaatttacaggaagcagttataaaggccgaccgtatagaagatgcatgtattagtaatcgcaactattttacttgcaattgaagcaaattcaataccagtgacaaaatcagacgatgaggcatttaaatttccaatcacgtttgagaatggtagaataggcgtaaacttcctaggatttcacgcttcagctggtttaggaggtttattaacaggtaatagtgcagatggtggcttacatgcggaagctggaactccgtttgggcaaagagcttgggctggattaggaggagatataaatggcgcaagtagatcagggggaggtctata

SEQ ID NO: 7097 - DNA, 398 bp, Diabrotica virgifera
  Clone ID: LIB150-046-Q1-E1-A8
ggaagtgaatggtagttttagtttattgtgcttatggtttagttttataggattagtctccgcaacattagaaattaatagtatcgatacaaattccattatcagaaaaacccggcaaagcagcttgaagtgcactctgccaccacagatagaaaatggaaaatggttaataactgaagcagatgttcagccaggtgatcaaatagaagttaacacaatagtaagattagaatgtaatgaaggatatcagttgtacccttacaacacactcatggcttgtgatagcaattgggatgaagaagattttccagtgtgtagaaaaaaatgtccttcgttttattcaacggcaactacaaagctgatatgcaaagataaagatgaaaacactatcacttgcg

SEQ ID NO: 7098 - DNA, 373 bp, Diabrotica virgifera
  Clone ID: LIB150-046-Q1-E1-B1
cccacgcatccgactaaacaagtgcctaaaaccacgaatttgaaacttcacaatattcctgcagatggaaactgtttttatttaactggaaatcatcaattgcaagttactggaagaccaactaagtctgtaaatgatttaagaaaagttaaagcagattttataagacagatcacagattgacttcataccaacttatgtgcaatgaattagatgaatctgaagtagttagccaggaacagtttgaaaattattgtaaacagctttgttgcaacaacaaagttatggggaggtcagttagaactgtgagctttatcgaatactcatacttgccctaataaagttatttatgccgctggtcctcccacactac

SEQ ID NO: 7099 - DNA, 432 bp, Diabrotica virgifera
  Clone ID: LIB150-046-Q1-E1-B10
aaacacattaagaactgattgaataacatttatgtttgtctcccggctgccataatatagcagccgggattgatttaattttgacagcatgttggaatgccctatccctatattatattgtagataatcgcttatcggctaatatttgcttaaacaggtctatgaaggatgtggatatattcttgaaataacgaagtgacataatagttaaagttggatttgaaacgcatacgaaaatattgttttcctgattaaagatatacctaatacaggaacaactaacggtagcttgtatgttagtggatataagcctgaatcacgcgtgccaaaaacagtttattaatagcaaactgaaaatttgttaaaagctgaacggtgtctagtcggacaaactttgatgtatggaaatactggagcagggcaagttttaat

SEQ ID NO: 7100 - DNA, 356 bp, Diabrotica virgifera
  Clone ID: LIB150-046-Q1-E1-B12
agtgagtcgtattaagcgcccttcaacgtttcccgaaattataagtctctcaagattattatcacttcttcttgcaatatggccgaaaaattttaagacgatggagaggcagatagaggaaagtcgagtctgaggaggtgagctcttggaggattgagtggtttgttctgtgttccgtccatgagatccgaattactcttctccagcatgacatttcaaacgcgtcaagcgtttttcagtcgtccgatttcattgatcataattcgaagctgtaattaaatatgggaaaaattaaggctcgtactaagcttagtttgcgtgttcctcaacaagaagtgatctttccagaatttcga

SEQ ID NO: 7101 - DNA, 375 bp, Diabrotica virgifera
  Clone ID: LIB150-046-Q1-E1-B4
actacataagccgaatgacaacaaatgtatgagttttgttatgctctactttatctctttatttagattgattagcaaattcttaatttaattaattaatctaaataaagagataaagtagagcataacaaaatggcgcccaacgtggagccattttgttatgcgacagtgacaacagcgaaagacagttccccaatagaaagacgattagtggaaagaccacgaaaacgatggaacgacaacttgctggagacacattgaaaaaaacagacagtcttgtctgcacaaaaagaagaagaattgcgcgacagagtcagatctgcacgtagttctgcagtaaatttttaaattgctgctttgttttcaactttccta

SEQ ID NO: 7102 - DNA, 390 bp, Diabrotica virgifera
  Clone ID: LIB150-046-Q1-E1-B5
acccacgcgtccggtaaatattaagcgataacaattaaataataaatttaaaaattaccagtaaaagttgaattagtaaccgctaggagcgacaccagcgaagctcagagcgtatagacaaaccaacactgtgtcatatgtcaacgatgactgttgacatagaacttaacttctctattccaaagaaaaacaccagaatctttatttttccaaaagtatacaatagcattaaaacagaatcgtataggtcaaaaaaatgttccagatttatattgacaatggataaatactgataaaatttgcagatgtttcttcattctttggcacaaacgtgtagttaatacttttttgccactttccacttgatttttgtaaagagattttaccaag

SEQ ID NO: 7103 - DNA, 393 bp, Diabrotica virgifera
  Clone ID: LIB150-046-Q1-E1-B8
attgtagatgaccagaccttctatagtttgttgaacaaacttcaacatttggtacaagctggagtcatcaacagagtagtcttggatgttgtaagaaactgggatcagcaaggtgtacaaggtgttagtgacattgtctctctgcaaggactctctggttatggcaacttccaaggacaatcaagaggatattccccactcagagagatcttaaagaatggagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagac

SEQ ID NO: 7104 - DNA, 416 bp, Diabrotica virgifera
  Clone ID: LIB150-046-Q1-E1-B9
acccacgcgtccggaaaacaccgccttcaagatgctccgcgtacaatctcaggaagttagcacccaagaatattcagtggagacgacgacatatgaaacatacgaatatgaaaccactttctctgtctcggagacatcgaaactagatcatttcgttttacctcctagaactacgatcttagcattgtctcagagcggcggagataaggaagaagacaaaaagtatgtcgtcaccaatcacggaaaagctgatctttttgttgaggtagtacacctcaataaccaagatgatgctccacaatggtttgtggtccagccagaccaaaccagtgagattgctattgaggacaatcttgaacaaagtgtgttgaaagtgagcaacaacagttacgaccaggaggtatcattttctgctg

SEQ ID NO: 7105 - DNA, 275 bp, Diabrotica virgifera
  Clone ID: LIB150-046-Q1-E1-C1
actaaaagacaaggctagcgctccttgtcgcatgtataaaaggaaagaagttgagtttgtaaacgccattttactatataactaaactatgtatgttgttatcccgcatttattaaagtattgtataatagcagtaaccacttatatgtatatataaatattcaatactagcttatattgattatttttgttgagatgaaggcgtgtatatttcaataaaaacatcgttacaacgaaaaaaaaaaaaaaaaaaaaaaagggaggacgcacaaaaa

SEQ ID NO: 7106 - DNA, 416 bp, Diabrotica virgifera
  Clone ID: LIB150-046-Q1-E1-C10
acccacgcgtccgcggacgcgtcgggattcaccggcgtcatcatggcgtatcgactaagatgtatgcaagagagcagtcaattaatgattcagtggagacgatcacacatgacgactgatacgattatgaggccacggtctctggatcggacacatgtagcctagataatatcgttttaactcctagaaggactatctgagcagtgtctcagagcggtggagataaggaagatgacaagaagtatgtcgtcaccaatcacggcttagctgatctttttgttgaagtagtacaccatcaagtttcatgatgatgctccacaagtgtttgtggtccagccattacataccactgagatagccattgatgacattcttgaacaatgcgtgtagcttgtgagcaacaacagttacgacca

SEQ ID NO: 7107 - DNA, 336 bp, Diabrotica virgifera
  Clone ID: LIB150-046-Q1-E1-C11
cccacgcgtccgagttatcatattgtaataacatagttttgagtatacgttcatgtacatttgaggttacagatcattagttaatggagtgagagaatattttatttttaaaatcgaagtctttatcttttgtaccgtgtgtctcagggattattaatgaatgtttatacatttaatatggacgaatcttaaaagagctacagtgattaatatttttatgtgtatgtcaactattttaaataatttttttgtcatgcagtgatattcggttttaaatataactagttttttacgatatataattcccttaattaataaccatattcttacaaacta

SEQ ID NO: 7108 - DNA, 374 bp, Diabrotica virgifera
  Clone ID: LIB150-046-Q1-E1-C2
acgagatgtcgattctgtaatttactcataactttctaaacgtaataagtatgtattggaagacgtgttttgtgcaaactgtgatacttattttaggatatttcattataaccgatggttatgaacaaaaatcaagagtcaaacgacctagagctccccctccagaacctgagaacgacgtagaaagtgatttcgaggaacgaaacaaagaattaaatccgaactacgtacctccgggatttcttagtccgtcggtcattgagtatctggagctaggaaagtccataccaggaaaacccggttctgattatcccgttttaagcatagtaccctacacaaatttctattgtgatgatcaatcgtatcctggattt

SEQ ID NO: 7109 - DNA, 347 bp, Diabrotica virgifera
  Clone ID: LIB150-046-Q1-E1-C4
aaaattcatctgtacttaccataaaagaagttctgattggtctattgaacatttgctctcaaagtgggacttggagtgtattgtgcacaatataaacaatttagggaacagtataggtctcaacattcacgatttaattggagatcacagcattcacttgcttgaaatttcaagaaaatcataagtaatggctacgaatggtgttcgccaactctacagattgtatgtgagcaacattccttggaccgttggttcaaaagagttaagaacttatttcagtaagtttggacatctgcaacaagctactgttgtatttgatagaaaaacaggactgtctaaaaactacg

SEQ ID NO: 7110 - DNA, 215 bp, Diabrotica virgifera
  Clone ID: LIB150-046-Q1-E1-C6
aaattggaggtggcagtgacggtggattcggaggtggattctgacgcggtttctgaagtggtcactactatcatccaattgcagatctacgtcggggtacccccagcagaacgtgaataattctggcgtcattgactagtctccgttgttcaagcccagagtcactactagatcatcgtcattatcgccccatccgcacccgctccatctgctct

SEQ ID NO: 7111 - DNA, 368 bp, Diabrotica virgifera
  Clone ID: LIB150-046-Q1-E1-C7
acccacgcgtccgcccacgcgtccgtttattaccactaatttgttgtccgtgcgttgtccctatatgttttaaaatgcaaaaaattgctttttttatttttatgggttttatgcatcatgcttacataatggcgccatggtactctaaagatacggttgaatgtgtaacgccaaagattaagactgtaataaaagagcaaatagaatgtgaccaaaactacactccaccatttgatacgatgaagattacacatagaaaaaaccaaataagacccttctattttgttaccgatcgttgttcttttagacctggaatagatgtctgccttgaaaggtcaatgaatcttgtttcagattgtttcaattcc

SEQ ID NO: 7112 - DNA, 354 bp, Diabrotica virgifera
  unsure (1)..(354): unsure at all n locations
  Clone ID: LIB150-046-Q1-E1-C9
aaggacgcgtggggaaaaaggtagcctatttgcactggaagcccagctacctaataacaaaaatcttactaaatcaacttttccatttctatcaaaaggtacccttcagtcaaatcggcaactataccattacctgtcgatttagaacctgtggcatgtgaccatttaatgtaaaggcacatacattttacaagtgtatgcaggatgtttcacggacattaggacctcagtttgagccaaagccaatcaacccaactaccttcgacgtgccacattctccatattacaattcacctattcangtgcgtcgactacatgaactgaatttccagatcggggagaatgcacaggcga

SEQ ID NO: 7113 - DNA, 451 bp, Diabrotica virgifera
  Clone ID: LIB150-046-Q1-E1-D10
gcgtgggtcgttacaagactctagagtgagtcgtatgaacggatttctagccttgcagaaggaccgttgatcggagggttcactatctcttagtcttagactataagacacgtcttcatgtcgctagaatagttaatgtttaccttgatgagattcaatttaaaaattatattgcccaccatatagcctctatcggagttaaatccgatcgagcattttatgacactttaaaacatcgtattcggaaaataacaaacctgagacacggccagggctaaggattgcatcacaaaaatttcacttaacatgatattcaaaatattcgatatttttgtccagcagtgtatttaaaatattattcttggttttaggttttggcagtaagcattcgtttatttgaattactactttatacttgcctactcataagttccaacaataatgttggaaa

SEQ ID NO: 7114 - DNA, 410 bp, Diabrotica virgifera
  Clone ID: LIB150-046-Q1-E1-D11
tatagtgagtcgtattatgtaaacgcacatctaaaaggcagcgtttagacaccgcgataaatcggagcaatttatcgatatcgatcgagttatttcaatctatcgttgtgtgtaaacggtacatcgcagcgatttatcggaattggagttggattggagttggtatcggattgcatcaatttattgtaacgatcgagttgtttcagtttatattcaatcgcgacaatatattgcagcgtctaaacagcttttaaaaaatcaataaaccatagcaatttatcgtcacaataaattgctcgcatttatcgctccgtctaaacgccacttaaaatgttactgttttatgctacctttttacggttctactagactactagacggacagttgagtgtatgttttgtttgtgttc

SEQ ID NO: 7115 - DNA, 358 bp, Diabrotica virgifera
  Clone ID: LIB150-046-Q1-E1-D2
ggcaaacctgaggctgtcaaacctgagactgcttggtgacaggttaggttaggttatgtaatgtaacctaactgcttggtgtcaggtaacctgagaccgtttggtgtcaggtttgtcgcttatcattgttgtattttatgttcgtggtgaagtgcttgaaatatttgaaatattagcaacgttcactgatttttttgaattttcagaaaaaggtttctactgtaccttgacgccatttttgttatgagatataaacaaaaattttaaattactgatcaaaattgtttatcaggtataaggtatgagtagattgatctttgaataaatcgtctcacttctcatctttcttactaaacct

SEQ ID NO: 7116 - DNA, 383 bp, Diabrotica virgifera
  Clone ID: LIB150-046-Q1-E1-D3
tgcacttctctagactgagtcgtagtagtcaaacctgagactgcttggtgacaggttaggttaggttatgtaatgtaacctaactgcttggtgtcaggtaacctgagaccgtttggtgtcaggtttgtcgcttatcattgttgtattttatgttcgtggtgaagtgcttgaaatatttgaaatattagcaacgttcactgatttttttgaattttcagaaaaaggtttctactgtaccttgacgccatttttgttatgagatataaacaaaaattttaaattactgatcaaaattgtttatcaggtataaggtatgagtagattgatctttgaataaatcgtctcacttctcatctttcttactaaacctataactcggtcct

SEQ ID NO: 7117 - DNA, 373 bp, Diabrotica virgifera
  Clone ID: LIB150-046-Q1-E1-D4
agtcccgtgatgtttatccagttgattgccccgaaataaaaaggaagccatgaagcccacctcaggtcgatgaccctgcttgtttgtagatgaaccccctttccgtgtagtttgtgacgtgtgataaaggattttgtttaaatatggtatgatatatttttttaaattttgcaaggatcccaaatggataaatatttttgttggtaaagagttttgaaaaataatagttgtttgtgctttcatgatgcaacttgtaaattaaaatgacagtgactttgacctttgacagctgcgtcaaaattttgttttgacatacactgtccaacaagttcttttgtcattcttttgttatgttaaattgaagatttttttt

SEQ ID NO: 7118 - DNA, 390 bp, Diabrotica virgifera
  Clone ID: LIB150-046-Q1-E1-D6
acccacgcgtccgctaccataaacagagcagtacctgttcctgtacctcaaccttatccagttactgtcaatagaccagttccagttccagtaccacaacctgtcgaagttccagtccccagaccagttcaagtaagttgttaatatacttaaaaactttattttattgcatattttatattatttttataatattgtaccatgtttattcattctgtttttcaataggttccagttccagttgctcaacctgttgaagttcccagaccgtaccctgttgtagtaaatcgtccagtacctgtagccgttccgactccagtacgtgtaccagttccacaacccgttgctgttccagtgccacaaccttatccagttacagtaccacaacct

SEQ ID NO: 7119 - DNA, 327 bp, Diabrotica virgifera
  Clone ID: LIB150-046-Q1-E1-D8
aaaatgacgtgtctagttcttctttccctagtaacccttactgtcgctgcatactacccaagtactggtatgcaggtgacagtaggagtagctggaaatgtgaaactagtcggctctcaaggttcccagattgacattcgtacaagtccttataatccaagaactgtcgacgtcaccctcacaagtccaaatgctccaaccagaactctgcaaattgatgaatccagtaacggccaacaacttggttattccaacctccaaggtgtcaacaaccaaggtgtcaaccatgctgatgttcttgctgatcttttcagtcaatatgaaggt

SEQ ID NO: 7120 - DNA, 432 bp, Diabrotica virgifera
  unsure (1)..(432): unsure at all n locations
  Clone ID: LIB150-046-Q1-E1-E11
gacaatttggaatttaattctttggaatcgttgtcagtggactttcataattttttacataatttaattttacggtagaataattttttcaacgttactgtttagtgctggcctttaaacgaatgtgattctagacgatagttgttaaatgatcgtcaagtcgaatagtggtgatctctgagagtctcctgaagtagtaaggcagataaatgaatagctgtgagtttgttgaaataagggtcctgacggaggctcatcacgtaaagcattgtaagttatattgttctacttatattccaagagtcaccgttgcatgccggaacgagaaatagattcagtttattgagaggagaaaaggctagcattgttttttgaaagatacctgcatctgtanggggtcattgatgacaataggcttgcaatagtttgttg

SEQ ID NO: 7121 - DNA, 311 bp, Diabrotica virgifera
  Clone ID: LIB150-046-Q1-E1-E12
acccacgcgtccgttcacgcttctgatctcactttgccaggagatccccaacacttcggggtaatccaccgataccaaccaattgaaattgaccgtgttgcgactctcgaacgcagcttatagcacatgaccaccatcagttacaaacatgacgagtcatttcctgcgacacgtggccacattagatacgatttggtggatatcccgcatgaacttcctgcttcacacgatgcagtatcagatccgagccttctgaaaaacttttccataataccacaatatgcagtatacagattcgagtcatgatcttc

SEQ ID NO: 7122 - DNA, 364 bp, Diabrotica virgifera
  Clone ID: LIB150-046-Q1-E1-E2
agctgcatgcgggcaattcactaacatttacagaatcgcattcctgctgctatgctgcagtgctgcaatcgacttatctcttttacctgttgagtgtgtgccgtgtaagtacgcggattcgaactccggttagtttcgcattaggccagtacttcttgtatttattattggcaggttttgaaaaaatgtttctttatgtaaactgttgaacgtgagggttttaaccacagttcagtgataagaataaggtatttaaggtagttgcttgtgctgttgcggtgcgttttgtattgacatgcgaatttggggagcctgaaagaagccagtggccagtttcttacaactatttcgagaagacaggacg

SEQ ID NO: 7123 - DNA, 376 bp, Diabrotica virgifera
  Clone ID: LIB150-046-Q1-E1-E4
atacaacatcatggcggacgcatccaaggcacagaagctgaagttggcaaattcaaggaaaaggtttaaagaattacaagaacttaagaaaaagaaaaatgccactgcttcagttgataattctgaaaaagatctacgtgaaccaacaccagttgatagcctagtaagttcaacacacagttcaattaatgcagaaagtgaacttgcaaatgtaacaaacactcaattgccaaactatttcatgactactgcacaatcggatcctgcaacattttttgaaaatttgtctacaactaatactaatgttggtgacgttgggaacatttctgatgtagtagaaactccaatgtttgaacaacatgtaccctttgataat

SEQ ID NO: 7124 - DNA, 418 bp, Diabrotica virgifera
  Clone ID: LIB150-046-Q1-E1-F11
ctcaattttcgggatggtgaagggtctggtgaagggagctttgtacatctgtgatatacagggtaactcaaaaatcggagtgagggaagcagtgcaatagataaaagtaatagaaattgtctagacagccagagactttgtgcattaggtgttttttttaataattatattgttacaataatatgaaattttttaaaattttactaataaaactttaaaatatatttatattcacattcgtacccaggtaaccaaataacatttacaaaacgttgaaaagacgtcataattatcaccaaaccacttcagtttatcacgttttttcgacgtcgaaagtcacgtgaatatctcccaccataactgacgtcatttttatcacgttatatcaaaaacgtagttttatgtcgtttttttagat

SEQ ID NO: 7125 - DNA, 406 bp, Diabrotica virgifera
  Clone ID: LIB150-046-Q1-E1-F4
aggacaattcatccaagtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcagcacttaaccaattggtctctcaagaacaacagttgagcttgagacagccacaaatctaccaaagagtaccacgtgtgtactaaattttgttttccttttaataatgatttttgaattttcaaggttaatttgaatggtggtttcccaaa

SEQ ID NO: 7126 - DNA, 385 bp, Diabrotica virgifera
  Clone ID: LIB150-046-Q1-E1-F5
acccacgcgtccgggtaaagtaaacaacaaaatgggcaaaatggctaacaataggaaaactccagtaatggcacttcaggaactagcagtaaaaaaaggttttccggttcctcaatacgaaatagttgatagtattttaggtactcataacgatcgatttgattgtcgagtaaaagcatgtggaatggaagcagagggaaccggcacttcgaaacaaatcagcaaacacgaggctgcatataaactcttaaaattactcgaagagggtggtatttatgacccaaaggaactaccggttcaagaatttcaagtcgaagttgctggtttagaaaatggtagttcggtagaggcacctgttaactggataagtccattgatcgaaatg

SEQ ID NO: 7127 - DNA, 56 bp, Diabrotica virgifera
  Clone ID: LIB150-046-Q1-E1-F9
agtgagtcgtattaaattgtacctcctagaactactatcttatcattatctcagaa

SEQ ID NO: 7128 - DNA, 376 bp, Diabrotica virgifera
  Clone ID: LIB150-046-Q1-E1-G1
attcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttcaacaggtagttcttcaacaatctcaaatcaaagaacaaatccaggtacttatccaacaagaacaaactgttccacaagaactagttttattccaacaattggcctaccaacaagttgaacaattcatccaagtattgatcaagcaattcatctaccaacaagct

SEQ ID NO: 7129 - DNA, 413 bp, Diabrotica virgifera
  Clone ID: LIB150-046-Q1-E1-G11
tcgcgggtcgatacaagactctaaagtgagtcgtaatatctataaaatacgtaaaatataaagactaatcctcgtatgtaaaggactgactgaggtcctggacgctgatgctgatgaacgtaaatgttgacagcgttaagatgggtattatgaaggatgatgggtgatctttagtcaatacccatagaccggggaacggcgatcaatacttagccaagatgtggtgcgatactaatgcactttgattccagtaaagattgctaataattcttagatcaaaagtgtttattccaacatttgttaagaactttatggtaatcaatgacttataataattacaagatattttaaaatttcaccctgtattattcgatgagagcataaatattacaatttgttggtttcagcttatt

SEQ ID NO: 7130 - DNA, 329 bp, Diabrotica virgifera
  Clone ID: LIB150-046-Q1-E1-G12
agactaacgcgcactattatccaaaccaaacgacttgtgggtgctcagcaacctcatttgacctgcaaacttggatggtaatgccgtacacaatcgtgtcttgcctgacgaactcactcagtccgacaatcgtatccacgtaacgggagacttcatgtctgaggtctccaattcattggatcagtaggactccaaaacgatgtagatacacagcaggttcgaagcctaatccgtagatgtgagtgaacttctagtgacagatcacacgctacgctcactggaactccgtctcctactagatcgatccagtcaataggagattctaagca

SEQ ID NO: 7131 - DNA, 381 bp, Diabrotica virgifera
  Clone ID: LIB150-046-Q1-E1-G3
acggacgcgtgggcgaccggtgaaaaacacctgaggaatacttaaccgctttgcgcaacttttacttacctcttttaagtagtataccgagtgatttcgaaaagttcttgcgtcatggagaaggaaccgcaaccagaatccatggcgacggttaccatcaagccggagtacaccccttcggagtattcggcctccgaaccaccaccggcatacatgaaaatgcgtagtacttcagtccaaatagccaagattatagcaataaccgtcgtagcttgttctgtaattttgggaggattcttgctagcttctgcctacgtctcagctaatgcttcatgcaggcagttggagcatgaacttgagctcctcagcgaagctgcagac

SEQ ID NO: 7132 - DNA, 113 bp, Diabrotica virgifera
  Clone ID: LIB150-046-Q1-E1-G7
acaaaaccctatagtgacgtcgtattaactcgcatctcacttatagccatatttaccatttaatctattcatcttctctaccatagctcccatctccagcatcacattcaacc

SEQ ID NO: 7133 - DNA, 377 bp, Diabrotica virgifera
  Clone ID: LIB150-046-Q1-E1-H1
aaccacgcgtccgaacctataatggatatatttttaatttgcaaatcatacttttaagttaataaaatgcattcggtaatatctgtgttaagtagaataaaaaatattgttcccgagcttcaaaatgctttaccaaatttgacatttcacgaagtctctaatgcagaattggataagcagttcaaggaatcccacataatagtagcagattacgacctactaacaccgcacatgtacagtttacctcaagccaaatgggtacaaggaacatgggcaggtgttaacgatttaatggcaaaagttactcaacctccaccattttcacttagcagattcaccggaaggcattttggggcgttaatgagcgaatatgttgt

SEQ ID NO: 7134 - DNA, 357 bp, Diabrotica virgifera
  Clone ID: LIB150-046-Q1-E1-H10
agtgagtcgtattaaagagggatgatcgaagagatagacatagtcgagatgatagatacagatcagacagagatagaagaagaagcaggtctagagatagagatagaaggcgtagcagatctccgagacgttcaagatcgagagaaagacctggcagaggaggtttccaaaggagatttgatagaggaggcagaataaacaaaccaggatttgatccgaaaaccgctactcaaactcctcaagaaggcgacagtacccaaaacagacatagatttttcatgcctggtattaccgggcgttttagagaccagatcgaaaaacgtaaagatgttatggcaaaagaaagatccggaacca

SEQ ID NO: 7135 - DNA, 256 bp, Diabrotica virgifera
  Clone ID: LIB150-046-Q1-E1-H5
agtgagtcgtattaaaccggcctcgtcactaccggctatgacttcaacatgcgtcattccagtgttgaagagttcgtggttactccaaacagcgtatttactgtataggtgtgaggtttgagtccctcatgagccaggggccaccctacgatgccagacatggcttcctcgctaaggtgatcatcagctatagggtccacaatagcggggagtgatcctgcatgtccatcgatttcctcattcagggttgctagct

SEQ ID NO: 7136 - DNA, 384 bp, Diabrotica virgifera
  Clone ID: LIB150-046-Q1-E1-H7
acaagttgtagacgacaaagatgaatcgtcagactcggatgactggccatctgactctgaatctagtctgtcatcatctgatgacgacgaaggcaaataccagagcataagggagcgtttcttgaagagaactgggcccgctcacgaagaagatgaagaaagggaaaggagaaaggaggagaaaaggaaggagagaaaggagaaaggtaggaagttgaaaaaggatgaggaggaggatggtgaaggcaagtgggagactgttaatcgaggtttcgccatccctagtgaaaaacctaaaatgttcgccaaggacgccgaaatcgatctaaaccttgtaatcaagaaactcagcgaaatcatggcagctagaggcaaaaagcgcac

SEQ ID NO: 7137 - DNA, 409 bp, Diabrotica virgifera
  Clone ID: LIB150-046-Q1-E1-H8
gcgggtcgacacaagcgtctaaattgggtcataatacttatcaagaactgatggaataaggtttgaacttgaatttaggtacttcgtaatttcaaaaatgatattttttacttcgatcttttttcagctttaagttgtttttaactcaaaaacgaccaacttaagaaaaattacaaaataccttttttgtttcgaatgatccaaagatctaaaaaaaattattgccagggccaaaatttttttttatctataaaaaaaagttatgatttttaattattaattaattatagtcagaacaaaattatatcccactgtttggggatataatgggggcacccattgttttttataatttttaacataccatattacatatcaaatggtttttattcattaaacgaatcggtgc

SEQ ID NO: 7138 - DNA, 346 bp, Diabrotica virgifera
  Clone ID: LIB150-046-Q1-E1-H9
tagacagattcagagaaaggagggatgatcgaagagatagacatagtcgagatgatagatacagatcagacagagatagaagaagaagcaggtctagagatagagatagaaggcgtagcagatctccgagacgttcaagatcgagagaaagacctggcagaggaggtttccaaaggagatttgatacaggaggcagaataaccaccccaggatttgatccgaaaaccgctactcaaactcctcaagagggcgacagtacccaaaacagagatagatttatcacgcggggtattacggggcgttttagagaccatatcgagacgcgtaaaatgttatggaagaaaga

SEQ ID NO: 7139 - DNA, 128 bp, Diabrotica virgifera
  unsure (1)..(128): unsure at all n locations
  Clone ID: LIB150-047-Q1-E1-A11
ctcngccttttttctccgactcagagaccctgaagagttttaggtgctgagtaagaagttttttgaggactgaagtgatttcatgtattctcagagccgtgtacgaggagttggattactaattgggg

SEQ ID NO: 7140 - DNA, 362 bp, Diabrotica virgifera
  Clone ID: LIB150-047-Q1-E1-A3
tcagaagaagtcaaagcaggcggtcgctatcgtctaacattgtatggagaaggatggaaagagaagctggcaaatgtaaacgatcagtacgctatgccacccaacaggagcattttagctcaattacaatttgaaaacttctacacttttacagttctcggattaatgtgtgctggtatcgctattttgaacgaaaaagacaaattgccgaaaagtggtggtgtatatagtgcaggagcagcttttggaaaaacgtctcttatgaaaatgttgatagagaatggaacttcattcgaaataaaaagtgtgaaagacatataataaatttaaataaaatataaatacacatccgtaacaactct

SEQ ID NO: 7141 - DNA, 424 bp, Diabrotica virgifera
  Clone ID: LIB150-047-Q1-E1-B11
agggtactggccgaaaaatacatacctttaattagctaataactcacttaaagttaacactaaaagggtttttctagtaaggagtttatttaattttttattagcttcaattttgggaataataggttttttgtaaaaacatagtttttgagttttttatgaaaaattggttggaaacatgcatttttctcacgaagaattaaaatttttgatctttaataactcaaaaagtatgcatttaaattaataagttcgtataacaaattttacttaaaatttatctctctatcgaattttttggttacttttaataaagtaattttcaccccgagggggggtggtatccacccccaggatagaggcgcaagttggcactatgtcacctttgttccttgagatgtcctctagccactcaccagttttc

SEQ ID NO: 7142 - DNA, 391 bp, Diabrotica virgifera
  unsure (1)..(391): unsure at all n locations
  Clone ID: LIB150-047-Q1-E1-B9
acagggatgaattttgacacagagttaggaagtatcgcaggggaaactattcctgatatcaacgtttaccaacacaaaaagactttggcgcaagggatgatggatttggcgctgttttctgccaatgccaatcagcttcgttacgtgctggacagttattctagacacccttacttctggggtagttgcatctgcatcattttgagtttgggattacaggtggcaataggcatcggtttaatatggaatgcgttgtacgacgtaaaagacgaaaaagaaatatgcgtagctaacaaaattaacaatttcactgtaattgggatattcttagtggtcgtagttaacgtttttatatccgcatttggagttgcnagaccccttacagccactg

SEQ ID NO: 7143 - DNA, 366 bp, Diabrotica virgifera
  unsure (1)..(366): unsure at all n locations
  Clone ID: LIB150-047-Q1-E1-C1
acggacgcatggtttatnttttaaggggataaatatttcttttattttatattaaattataaaatcattataggaaattanaagtagagatgaataaatgtgtaaatgtgtagaagttaatgggaatatatctattcagaaatatcttctgcttaacttaaagtttaatacttaaatcgaaatgcactagcgcctgtctcttgaatcagatcgtgctctggaatctcggcttctataacgagacctcgaccgtttcggtgacctcgaccgttttggtgacctcgacattatcagcaatgtttccctgttgtggggatagttgaatgagttggaaacatcactcagttgacggggcggcaggtaaag

SEQ ID NO: 7144 - DNA, 429 bp, Diabrotica virgifera
  unsure (1)..(429): unsure at all n locations
  Clone ID: LIB150-047-Q1-E1-C2
accacacagtcgccaacgcgtccggtaaaaaattaacaaaacaacagtacaaagttacgtaaaagtttgaaaaacattcaattaaaatctttaccctatgtatttctgtaaaagtgaggaagcggctaattacanacagactgaaaaacacacttacactgattgcactacattcatactcctttanacgggaagtaagctacatagagagttaatgtactaaacgaagtggaaacccattttctaaattttttcgttgcggtttctttgagatgtttgttgctctgaaacgaattaatcatcttatgtgtcgggctttggtttgttcctggtgttggttattttgcaattaacgcatgaatatataatacaagtatttatgattatttcattcataggagattctgaccaataaaaacctacagaaat

SEQ ID NO: 7145 - DNA, 417 bp, Diabrotica virgifera
  Clone ID: LIB150-047-Q1-E1-C4
acgagcgggccgccctttttttttttttttagaaacccacaattggcatctgaaaaacaagatattgtaccaatacattcacaaatattgatttatttaaccatttgtacaaaaaaaatcagtattttaaagcactaaaagataattcatgttttttaaactaacattacctagaaaaaaagtttcttatacgttttttactgtctttaagcttttatgtacaatgttcgacttttccatcttgtttttattgaatgctgtatagtttttgcaactagtatgatgtaatatgtgatcttagctactagatctacaacttataaatgtatatacacacaatcttgcgcgttcgctgtgaagagtactgtgagtactgggtaatctagagaaacggtacttaacgatgttttataccaa

SEQ ID NO: 7146 - DNA, 433 bp, Diabrotica virgifera
  Clone ID: LIB150-047-Q1-E1-C7
accacgcgtccaatttaaaaagtgatttattgacataaggtctgataaggtaatttcccatacattaactgaacaggccattaacatctggtgttttaaaagctgaaaaggcattttacctgaatacacactgatatatttcgtttcttaacttaacaggcccttctatgcatatggtttgtatattaaatgtgaattataaatgggacgtattatttcattttgaaaaagttattaaaaattaaaattagcaaaatagtaattgaagcgtgtcgccacaccttgtaacatctcatacccttccttgtaatgatttgtatattcattttattccgaagacaaattatctaccctgtatacgagttgaaatttttggactactttctagatatacatattttttattttgcagtattttttacttttgtacatt

SEQ ID NO: 7147 - DNA, 422 bp, Diabrotica virgifera
  Clone ID: LIB150-047-Q1-E1-C8
cacacgcctctacagtgactcgtgttatgacaagtcttagcaaacgttgctaccgtcaacatgttcaaattgactgcattcatcgccatcatggacgcagctttcgcaatgccagcccccagccctagccgcaaaccggatccactggctcagtattcagcacgtcttcccttgacatacaccgcatcgtagcaaccattggcgtacacgaacttgggctacaactaccatgccatatgcctacaactacaacgactagatcggagatgcaccattggcctacatgaacctcaactattacgaagatgaagtctagtgaacatggatcgtgactgaaaggaaaattagcaaattagtttttggaatgatcatgtgcgaatttaattctggtagtaataaattgacattttacattagaatta

SEQ ID NO: 7148 - DNA, 391 bp, Diabrotica virgifera
  Clone ID: LIB150-047-Q1-E1-D1
agaacttatagcatcacccgccctgctttatacggaagaagatgcgaaatcgttcatagatgaaatacgaactgaaaaagcgataaaggaatcaattgatgacgacacggaaacgaggtgttcggaggattcgatactaaaagaaatacatgtaaacgaaggaattagcaataataaggaggaagctgttaggaacgaaaatgtagaaaggaaaaagagcccaagtccgaagaaagaaacaaatgataaggaagaagacagcgacggtgaagacgaatccagtaataaaaatagtgataagctgaataacggccaaaaaatgaatagcgatgatgaatcagttagtaaagaaccaattgaaaactgtaaaagcgaagaaagtgataacaat

SEQ ID NO: 7149 - DNA, 437 bp, Diabrotica virgifera
  Clone ID: LIB150-047-Q1-E1-D12
tagcattaatcatcctacaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaaaataccagttccagtgccagtcaaagtacctgtaccagtagatcgtccatatccagtacacgtacctaaaccatac

SEQ ID NO: 7150 - DNA, 416 bp, Diabrotica virgifera
  Clone ID: LIB150-047-Q1-E1-D3
agttgaagctggactcatcaacgaaaccatctacgatgtcatcagaaactgggatcgtgaataccgtatgcaaggaattagtgacattgtccccgtccaaggagtacgtaccctccgccaatatgctgaacaagtaggagatgttatgcctcttggacaaaatttgcaatatggaaaccaaagaaactgggctcttgaccaaggtttgttgcaaacttattctccactcagacatttccaaactctgctcggacaaatccaacagcaacgtgtacttcaacaaggtttattgacccaacaacaatatttacctcaacaatatctatctggggaataccttcttgaagatcaaatgaacactaaccaaatcttgaaccaaatttatagacaacaacttggacaatctccattgaacc

SEQ ID NO: 7151 - DNA, 423 bp, Diabrotica virgifera
  Clone ID: LIB150-047-Q1-E1-D6
aaaataagatgactactaaagtatcagtaattttgtttttgtgcttaataatatggaaggaaaacgccgttgaagcaaataagaatttaccaggtaatctgataacctatggggacagtcagtactatattgatgataaatttaatcattgttggtgggaggcatggagacattgcaaatctcttaacatggatctagttagtattgaaacacaggcagaaaataactttctttaccaaaagttgaaggaacgatatggtaacggacccgaatattcgttttggactgctggagccaaagaagggaacggatgggtatggaaaaatacaaatggttttgttaactacttcaactgggcacccggtcaaccagacaacgctggtctaacccgtatagaaatgagatataattgggcagctggac

SEQ ID NO: 7152 - DNA, 392 bp, Diabrotica virgifera
  unsure (1)..(392): unsure at all n locations
  Clone ID: LIB150-047-Q1-E1-E1
tataatcaatcatagtaattgttaattttaaggaccaaaacggaaatccgttcattggaaaaatcgaaggtaaccgttgccaaaagctgacaatcaacccccaanaaaatatggcaattggttacgaagtgacacctaaaggcgcgcaaagtttggaaaaaagacgaaatacagtcaagtggagaatttgtattgtagcaatctgtagctattacctccaaaaagtgaatggtgatgctggtatgtctgctgtttgatacaaaaaccaaactcgtatgacgagttgcctttttgtaccatccggtagcgctataataacgatttggcttttggtcaaatcgaatcttatggtgctgtttttggtcgagctgcgaaattcttgtgtaaagact

SEQ ID NO: 7153 - DNA, 435 bp, Diabrotica virgifera
  Clone ID: LIB150-047-Q1-E1-E11
agtgcaatttgttgaagattttggacatttattgaaagtaatctctatactttttgttgtacttagagtagatatgtagtaggttggagttgatgacacgatacaaaaaattacgctcaacatttttttaatgaaacacgtaatttgcatctatcagtagcaacaaaaaattttattttatctttggttgaaagactgatacattttgtacacacttgaacgaatcaaggaagtgaaaaaaatgtatatcaaagtgtgtaaaaagtatttatttccttagttaagcgcttaccaaattaagtatttccaaaatttatacattataaataaatcatgattcgagagtgctcttagtagcatttaacgtgtcttggtttgtttatttctactgcatcttggttgtaagtttagtatgtatagtgagatcattttttg

SEQ ID NO: 7154 - DNA, 437 bp, Diabrotica virgifera
  Clone ID: LIB150-047-Q1-E1-E12
tgggtcgatacaagcctctacacagacgtcctactaaactcccggtggtgaacaggatggtgctccacgcgctattagcagtgacgacactatcgaatctgtcattttcaacaggattacatcgttcttggggtcccatactttgaaaatcgatttgaaaggtagtgaagttgtcaacgcagtgcaatctacagcccgttcattaaacgattatgccgaatccttggaagaagaagaaaatatgatcgaaggtgccagtgaatccagaaagaggaaaggcggtggcaagaaaggcaaaggacaaatgggtgctctcatgggactgatgggacttaaagcagccatccttggaaaactcgccctggccagtattgccctcatcgctggtaaagcccttcttattggtaaaattgctttagttctctcagctattattg

SEQ ID NO: 7155 - DNA, 321 bp, Diabrotica virgifera
  Clone ID: LIB150-047-Q1-E1-E3
cgacccctataactacgacgaagtatacgccgcgcaatatggtggatggggcggtgacaaccatcgtggtggtttcaatacaggcagaggatacgacggactcagatgtggcggcaacatagatggtggtgcccgattcggtggcggcaacagacctgcgggaggttccttaaacatacgaggaggacgaggatgaggaaatcgtgatggattttgacgcagcggtttgggtggtaaccgcgacagcttgggccgtggaccattcggtggaagagacagtggttttggtggacgaaaccgacacagtggttttggacgccg

SEQ ID NO: 7156 - DNA, 418 bp, Diabrotica virgifera
  Clone ID: LIB150-047-Q1-E1-E4
accacgagtccgcaacaatacagcagtatccatcatgaagtgttttgtactgttcgcttgctgtgttgcatatatttcagcttcggcccttaattttcagcctttccaatcagtatacgtagacccatgtgcgtgcagaaaatgtttagaggaaatatggaacagaacactacagcttaatcaaaatttgaattcagtcaaccgcactctaaacaatttaacagtgatactcgaaaaaaatgtaacaactgaggtgacgtatcaacttgacgaactctgcaaagtggaagaaaacctcgacaacttagtagccacagaaaaaaatatcacagttgttcttcaagcacaaatttgtaacctgacagatgtggtaggtgacttggaaaaatgttgcagagatatggagtgtttggaacag

SEQ ID NO: 7157 - DNA, 138 bp, Diabrotica virgifera
  Clone ID: LIB150-047-Q1-E1-E5
acttatatccagttatctgcatctgaactgaaagtgtaagttattagatagtcagtattgttaaacaatcaaaagtttatgctgttttaattgaagctttattagctaatcaaatcaatatgcagcgctggtttttct

SEQ ID NO: 7158 - DNA, 431 bp, Diabrotica virgifera
  Clone ID: LIB150-047-Q1-E1-E6
caagcctctagagtgagtcgttgtaagcgtgaaaaatccaatttttgcgcgcacacaagttgtttttttggttatctgtgaatgtccccactgacacagtttttcatgaacacgggcacaaattctactatatcctaaagaagccatcgttaagactgctgcgagaccgcaatcaccgactaagaagcgtggcggagcacctcacaagcgcctttccaccaacaaacacgacgtcgccgtagtcccactacctcgagcgccttttaccattaccataccaatcacgatttctacgttttctaacctgcaagataatgtctgctactattttgacgcgaattaatttagcagttcaaaatttgaagcatcatgtacttaatacttttggaagaggttttccaccagatgcactttgcctagcaggaatagaa

SEQ ID NO: 7159 - DNA, 417 bp, Diabrotica virgifera
  Clone ID: LIB150-047-Q1-E1-E7
tagatatcgtctcatgaaatagggcttcactgtacaggttaagcagtagcggcgacagaacacaaccctgtcttactcctctctttatatcaatattctcggattcttgttcttctgtctttatattggccttttgattccaatacagattgatgatatttcgtaaatcccgtctgtctatatctctgtttttcaataattctattagtttttcatgtcggaccctgtcaaacgccttttcgaagtcgatgaaacagaaataaatatccaggttcatatctaagcatctttgagagaggacattaaacggaaacaatgcctctgttgttccaagtcctttgcggaacccaaattgggtatcatccatatcaaacggatggtagtggtctctaaatcgtaattaaatcttagctgccg

SEQ ID NO: 7160 - DNA, 401 bp, Diabrotica virgifera
  Clone ID: LIB150-047-Q1-E1-F10
aacgaactgtacatgaaatcgaaaaactgaaaaatacgtgttcaataattttcaaaaatctatcgaatgacaccaaacacgatcccccactccaacccctggatgtggggagggataacattaaaaccttaaatggaaaccctcagtttttattacagatttggattccttacgtaaaagtaagcaacttttattcaagacatttttttgaattgtagatagatggcgctataatcggaaaaaaccatttatcgtgatatatatatataatggatttctacggctgtcgccgcctctccatacccagcttccaattttttctatcgtaacacgtatcttcatcaaattgcctcgaatccattgcgtcctgaatattgtcgctccagcttctccgtggtcgt

SEQ ID NO: 7161 - DNA, 386 bp, Diabrotica virgifera
  Clone ID: LIB150-047-Q1-E1-F3
accacgcgtccgatagtccaatcagaggagcagtcaacccatacgacccccataactacgacgaagtatacgccgcgcaatatggtggatggggcggtgacaaccaacgtggtggtttcaatataggcagatgaaacgacggacccagaggtggcggcaacatagatggtggtgcccgattcggtggcggcaacagacctgcgggaggttccttaaacagacgaggaggaggaggaggatgaaatcgtgatggatttggaggcggctgtttgggtggtaaccgcgacagcttgggcggtggacgattcggtggaagagacagtggttttggtggacgaaaccgagacagtggttttggacgcggaagagacagtggttttggtgga

SEQ ID NO: 7162 - DNA, 321 bp, Diabrotica virgifera
  Clone ID: LIB150-047-Q1-E1-F4
agtcagaggagcagtcaatccatacgacccccattactacgacgaagtatacaccgcgcaatattgtgaatggagctgtgataaacaaggtggtggtttcaatataggcacatgagtcgacgggcccataagtggcggcatcataaattatggtgcccgattctgatggcagcaacagaccttcaggatgttcctgaaacagaggaggatgaggaggatgatgagatcgtaatggatatgcatgctgcagtttggctagttaccgcaacaacttagtcggtgtacgaatcagtggaacatacagtggttttggtgtaggaa

SEQ ID NO: 7163 - DNA, 368 bp, Diabrotica virgifera
  Clone ID: LIB150-047-Q1-E1-F5
ttcgcgtgatgtgtgtgtgcacttatggcttaatagattgataattcagatagtgtgtcatcagcttacgctcgcccattagggattgtggacctggagtatgcggaagaagtaatgggttcaaatatttcaattccatacacattttcaaggctactaacagcctcgatgttgtcattttcattcaccaacacgtctctatgattcagcgtctaccacgcagcgttagtcacatagctggacatcaaacatctgctgaatcatggtgtaccggacgagcagttgcacattttcaccttgttataggaggtgtactcatcgtactggtctaggagcattcggtaacaggtgtagtcgtgtgctcatgt

SEQ ID NO: 7164 - DNA, 368 bp, Diabrotica virgifera
  Clone ID: LIB150-047-Q1-E1-F6
cctttggtaccggcaagcaagtcaccatcaacgacgatggcactctcaccatcttgggagaaaatggtaagaaaatcgtcatctcaaacgccattggaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaaaaaagacagcaaaaactccaaagacaccaaagagtacaaaggaaaggaaggaaaatcgaaaactcaagctcaattacttcaagaaatcttc

SEQ ID NO: 7165 - DNA, 434 bp, Diabrotica virgifera
  Clone ID: LIB150-047-Q1-E1-F7
cacgcgtctaaactgacgttctgctaatgtcctccagcaagagaaagctttaaatcaaacccttattgatatttctgttcttgaaatagagcttagacaactcgatgatcttcttgaaggacaagaagataagctaatagacatctcggctgaattagcagcactaactgtaactaagaactacattaatcgtttacttgccgatggaagccaagccctccaatgcatcatagacaatctcaaagaagtttgccatgatctacacgatgacgtcgataatgatgtcgatcaacaacaatctcaaattataaatattctaagtgttgttatgaaagttgaagattgtaagaatggaaactcatgtcctgctgctccccaataaaatgaactgtaaaccaatcatgctcgcttaacacaatttcttttgtaaaaac

SEQ ID NO: 7166 - DNA, 399 bp, Diabrotica virgifera
  Clone ID: LIB150-047-Q1-E1-F9
gtcgtatttcgccctacttttcattattggagttgtgtatgttcattgtcgatgtaaactgaccatgaatgacaagatctgtccattggataatttcatacgaatggttaccgagataatttagattcgaaggatattagggatcgattgcaaaaacataaagacttctgttctaagaagtaccaaaagtaccactatttactcaaagacatttccgtacgtttaagagaacacaattgtatcagagctatggattctattagaccagtatttataatgttggaggatttgagattgatgactaatgatctattgcaatcggtacgacaactatgtgtgctgaactgtgaacaccgcatgacgatatgctggaatttggttaccaattacatggccata

SEQ ID NO: 7167 - DNA, 396 bp, Diabrotica virgifera
  Clone ID: LIB150-047-Q1-E1-G10
agcgtccgagaaaacaaagtttttgtacaactggaaaattcggttgcctttggtatatattttggttttgtacgaccaataactcggctacaaacataggcgatcattagcgggtcactccttcgattttcagatctggtcgtacaaaaatacattttttattaagtacaaaagtagtatcgatttttaatatttaagaaacatcatattcactccgtgcgtgaccatagcggggatacacgaaactatgtcagcgcccgtagcgccgaaatatgacaattttggcgaatttttgtaatgtcagtgtcattatgttcgttcgtggaccctgtcggtgacttttagtccacaacaatgcatgcttactttaattccatattatatttaattaatgta

SEQ ID NO: 7168 - DNA, 451 bp, Diabrotica virgifera
  unsure (1)..(451): unsure at all n locations
  Clone ID: LIB150-047-Q1-E1-G2
caagggtcgatgcacgcgtctacaataaataccgcctatcaacatganacgatcccagcaggttacggtcactgaaaccaccccaggatattaagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttatt

SEQ ID NO: 7169 - DNA, 416 bp, Diabrotica virgifera
  Clone ID: LIB150-047-Q1-E1-G6
acccacgcgtccgcggacgcgtgggattaattttaattcgtttctattatttgccttagttttcctgtgttgtactcctacttttattagattgtgttccataaatttgtattgcaattatatattggcaaacgtttctacttaaagagtgtataaagaatgtttacagaatgataaaaaattcatggaattgagagatgtataatgcaagcctggtgtagaggctatttgaatccactgtcttacgtcagtttaactgataattagatgcaaaatttcactggtcattttgtgctcatattttttatgaaaattattttttaaatacttcctaagatttcagcaacactagattaattttgttttaatattaacacattgaaaaaagcaccacaatatcaatcatataatagaaa

SEQ ID NO: 7170 - DNA, 428 bp, Diabrotica virgifera
  Clone ID: LIB150-047-Q1-E1-G7
gcaagcctctacagtgacgtcgtactaacgcgtgggcgaatccggcagcatgaccaaagatttggccatctgcatcaagggcatgagcaaagtaaccagagaagattatctggagaccttcgaattcatcaacaaattggcagagaaccttaaaaagaagcttaacgcttaaaacgtttattcctatgcaatccaacttgaaaaggcgtatatctggaaaatggaaaaagattgttttgtgtattttgtaccaacgaaacttatttgatttattgtacgataaaactatagatttgttgtgtacatatttgtcgaagtttttttgtcttagtttatattaacttccagtacattttacactaattttacaccatgaaaccactaatacagtaataatccattacaaaaccgcaaccataaactatata

SEQ ID NO: 7171 - DNA, 432 bp, Diabrotica virgifera
  Clone ID: LIB150-047-Q1-E1-G9
accacgcgtccgcccacgcgtccgagaaaacaaagtttttgtagaactggaaaattcggttgcctttggtatatattttggttttgtacgaccaataactcggctacaaacataggcgatcattagcgggtcactccttcgattttcagatctggtcgtacaaaaatacattttttattaagtacaaaagtagtatcgatttttaatatttaagaaacatcatattcactccgtgcgtgaccatagcggggatacacgaaactatgtcagcgcccgtagcgccgaaatatgacaattttggcgaatttttgtaatgtcagtgtcattatgttcgttcgtggaccctgtcggtgacttttagtccacaacaatgcatgcttactttaattccatattatatttatttaatgtattatcgtttaaatgataata

SEQ ID NO: 7172 - DNA, 419 bp, Diabrotica virgifera
  Clone ID: LIB150-047-Q1-E1-H1
aggttggagttggtgaccttgtacaattaacaaaacttctcaataacaattcaaagttagatgccaaatagatttggcatttttcatgatgtttttaattttctccgatcttgaacatctatttttgcactattactaatttttcgtggatatgtaggtaaaatacatagtgagaattgagtaggatcaggaaaaatcgtgcagaaaaaatgacaaactaaatttaacaaatccaggtatctgaacttttttagttattgtaggcttatgtatataaataaaagctatacattttctgtagagattttggcgccttttttaaataattaacaatttattgtaaaaaatgccatattttcaacttaggttttcttcgtataggtctataatgactaaaacaaatcacatacctgaatttg

SEQ ID NO: 7173 - DNA, 426 bp, Diabrotica virgifera
  Clone ID: LIB150-047-Q1-E1-H12
cgggtcgaggcacgcgtccggatatcacgtgtttttggtgtgacttttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgaatctggagaaaagaaatcatcctccgagtcctcctcgagcgagaaagaatccagcgaagtaaaaatccaggaaaagaaacttgccgaacc

SEQ ID NO: 7174 - DNA, 422 bp, Diabrotica virgifera
  unsure (1)..(422): unsure at all n locations
  Clone ID: LIB150-047-Q1-E1-H2
tacacacacatctgctaacgcgtccggaacctcgtatgtgtgcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaanataccagttccagtgccagtc

SEQ ID NO: 7175 - DNA, 406 bp, Diabrotica virgifera
  Clone ID: LIB150-047-Q1-E1-H4
ggcggtggatccggaggtggatttggaggtggatccggaggtggatttggaggtggatccggaggaggctttggacgtggaattggaggcggcggtgacggtggattcggaggtggattcggaggcggtttcggaggtggcaccactaccatccagaagcacatctacgtctaagtagccccaccagaacctgaacaattcagacctcaaagaccaatctccgttggacaagcccagaaacactacaaaatcatcttcattaaggccccaagcgcacccgccccaactgcgccagtaatcccactacaaccacaaaaccgaacaaaagaccttggtctacgttttggtcaagaaaccagaaaaaggacccgaaatcaccattcctactgctgcaccaacacaaccc

SEQ ID NO: 7176 - DNA, 438 bp, Diabrotica virgifera
  Clone ID: LIB150-047-Q1-E1-H5
ctcgtgggtcgatacaagactctacaatgggtcgtattacttcttcaagggagctttctccaacgtcctccgtggtactggtggagctattgtattggtcatgtacgacgaaatcaaaaacttgattgtgtaatttgtttttcattgctacaagaatcgcgcatcattatcaacactccaatcgatttttcctatgaaatatttagccaaattcgatgatatattcttctagccgtgcttgtttcaaaccattccgggtggaggcggaccattttatagacctttagagctcactgagatggttttgctgtcaccccagcccttgctgagcacgacttggaggagaatgtatatagttgtacatttacttatttttttgagtgccgtaagtaagttcaacatcctcgcccgggcgaagtatagactagatttttgtca

SEQ ID NO: 7177 - DNA, 420 bp, Diabrotica virgifera
  Clone ID: LIB150-047-Q1-E1-H7
aataatgataatagtatacagccctatctacttcctttctttgttttgaacgcatttgaagggatcccatttgactgaatcgaaagcctttgtgtaatcaacgaaaaaaagcaacattggtatattgtattctttcactttttctattatctgtctggtgtacaatagttgctcacgcgttccttttcctggttcaaatccgcattgttcggctatctcaggaagtagaaagttcatgaggaataagggcaatggttctgaattgctgcatatggttaatgatccttttctatggataaggataaaggttgattcgtaccactcatcaggctattcacctgcgattcatttcatgttgcacatatccagtattacatctacgcctacgccaatctcatccattgcttttagagtctccgc

SEQ ID NO: 7178 - DNA, 165 bp, Diabrotica virgifera
  Clone ID: LIB150-047-Q1-E1-H9
gtgagtcgtattaaagagggatgatcgaggagatagacatagtcgagatgatagatgcaggtcaggcaggcatagaagaagaagcatgtcgagagatacagatacagggcgtgagagatctccgagacgttcaggatcgagagagagacctggcagatgaggttt

SEQ ID NO: 7179 - DNA, 382 bp, Diabrotica virgifera
  Clone ID: LIB150-048-Q1-E1-A1
cccacgcgtccgcccacgcgtccgaaagtatccgacagggcagaatggaagaacattgttaagcaggtcaagactgacaaagggttgtagcgccattagaagaagaataagtgttgtttttgtagtctaccggtgaccctaattgttgacatgaaatatgaaacggaattgtaagaaaaaggaataactgtttaccctcaaatattgtttcagtaatttttcatacccccgaaggaatagtttacaatttgttttatattttgtacataggtagaaaaaaatgtttgttaggcagttgagtgacgttgattttattaataaaatactcaaacttgttatgaacagttttaaaaagtttatacaaaagttgatacgaaatatg

SEQ ID NO: 7180 - DNA, 388 bp, Diabrotica virgifera
  Clone ID: LIB150-048-Q1-E1-A11
ctcgcgggtcgacacacgcctctacattggtgcctcctagctttggcttcagtttttggagttaatggcggaggacatggtggccaccatcacgtagtattcaaaatcccagaacacattcacaccgtcaaacacacacataccgtctataaaaccatccatcatcatacaaaaggtcacgaagagcctcacagccatgggggaaaaccattccattggcactgaagaaatttcacagttgaaatttagataagataattttttgcaagctttaattatggggtaacattccagtatgatttttttttcaaaacctatagattttctatatataagtaatatggaaaactgctgaggtcgccaaactaaaagcaaaacgcttcgggat

SEQ ID NO: 7181 - DNA, 355 bp, Diabrotica virgifera
  Clone ID: LIB150-048-Q1-E1-A12
accaagcctccgggaaaaaaggttgtggaaaaaaaaccttaataaataaattttggaaaatccccatttaacaaacaagccaagggcaattgcataagaaatttccaaccttcccggaaaccggattaaggataccaaggaccaatccgggcgggcaaaattaccataaccagaccaatgcctttaaggaaaattagaaaccacccaaaaaacttgggaaaaagggccttaaaaggaacatccggaactttaacagaccaaacctaaggccccaaacttaagaccaccacttaaaataccatttgaaaagaatttgaaattgacccccaaaaaacatgggccattaaaaaccatt

SEQ ID NO: 7182 - DNA, 388 bp, Diabrotica virgifera
  Clone ID: LIB150-048-Q1-E1-A5
actgcgatgtcactgcacttaaattgtctggctttactactctgtgttactgcctccacagccattgctaccatcatcccttcgtcaacgattgcacctgaagttgcgtcggatgttcgagttcagtgcaataacgatcaaatcgttataaacatcggcaccatctcaggacgatttaatggtatggtttatcccagaggactgtccaaaaatagttcttgtttgggcgaatggatcgaaactaaaacacccattgaatacactctacctcttcgaggctgtaacacaatgagcactgatttggatgacggtggtatcgaatattataatacgattgtagttcaacctcatcttaaactagtaacaaatcagggaagaggattccaca

SEQ ID NO: 7183 - DNA, 433 bp, Diabrotica virgifera
  Clone ID: LIB150-048-Q1-E1-A6
tcacgggtcgacacacgcctctaaaattattcgtaagaatgtaccgaattggactgatggatgttttttctttggtgatgggggccaactgcttcccagacggtgcgcccgtggatgcttgtgtgaagccgagggttaaccagccataccatggacaagccagaccccaatcaccagaaaccaaccccttcgaggttctgcaatcagaggccgattatggaccgggaactcaaatcacagtgaccattcaaggggtgtccaattttaaaggattcctcatccaggcccgtgacgtcgcctccaacgagtggataggaagctggatagagacgccaaacaccaaaatccattccgaatgcagcgccatcactcattccgaccctaatccgaagcaatccgctacattggtaaggcaagcatcacacaacaccag

SEQ ID NO: 7184 - DNA, 402 bp, Diabrotica virgifera
  Clone ID: LIB150-048-Q1-E1-B1
ctaaacccaacaaacaccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagttagcaaccaccatttacaaccagga

SEQ ID NO: 7185 - DNA, 365 bp, Diabrotica virgifera
  Clone ID: LIB150-048-Q1-E1-B11
agctagttttttaatctcgattttttaagcaaagcacaggttatttacatttgagtttgacacttcgtgaatgtcaaactaaattttaattaagtattaataaaacatcaatgacatttgatagtgaatttaattattatataaaataaataagatgtccaaaaatacaatttgagtatagtttaaaagcaataatttattaacagctttaaaaaggtttatacgagtatacggcctcccctttatgataaatggactgttccatttgctatgaaattaaaatatggtcggttcgctgaactcgacacaactggccaagtgattttagtaggtaatttttttgttttttgcgaattttgccaaaa

SEQ ID NO: 7186 - DNA, 413 bp, Diabrotica virgifera
  Clone ID: LIB150-048-Q1-E1-B12
ctcgcgggccgacacaagcctctacagtgactcgtgtgaaaaatgacgatgaaagagaaaaaactggaaatggtagaactggactatccaagaagagcgtgtcggatatccatatacttgatcacatcccaatagaagaaatcaaaagtaaaacaggaaggatttacaataccgtagatacaatagaatttaaacaacctttgttgtttaaaaattttaacatagccaatgattggaaaacaatccaataatattgaatttagagtgataaagtaagttgacagctcaagaaggttattgtttaattacaacagacaaatattctgcatactgcatggatagataatatcagatttaagtcttcacagtatgatatattaaaagtctttaacaaaataatctttgcgtgggta

SEQ ID NO: 7187 - DNA, 269 bp, Diabrotica virgifera
  Clone ID: LIB150-048-Q1-E1-B5
aggcatcactatacacatcattaccaaaatccactcgcctcgcacgtccttcgtgcaatgcaatgcagtgtcatactgaaacgacgtcaacagggattacatctacacattagacacgatcaagtcccactcatacatgagttccttctcaggactcgtcgtggaatggcaatcatcgcacgagacttcgcgtccgactcatgacggagatggttcgtcgtagttccaagcaaccaacatgatcattcgtgtgcgcgtcaaggatcagc

SEQ ID NO: 7188 - DNA, 394 bp, Diabrotica virgifera
  Clone ID: LIB150-048-Q1-E1-B7
cccacgcgtccgccgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaaca

SEQ ID NO: 7189 - DNA, 138 bp, Diabrotica virgifera
  Clone ID: LIB150-048-Q1-E1-C1
cgatacaggcctctatactgacgtcctgataaaaaaaaaaaaaagaaaaaaaaaaaaaaaaaaaaaaaaaaaaaaaaaaaaaaaaaaaaataaaacaaaagaaaaaaaaaaaagaaaataaaaaaaaaaggaaggggg

SEQ ID NO: 7190 - DNA, 377 bp, Diabrotica virgifera
  Clone ID: LIB150-048-Q1-E1-C10
tacacatcgacgtctgttatgctccgcatattccatctaaaatgaaactcctgggttattcagcgttctgcgcactcttattgttggcgaacgctgaagacaagtcatcggccacagacacgaaatcagcagagtctcaaaccaaggaaaaacgcggtttgtctctgggatacggtggcggtggacacgacttcggtggcggcggagatttcggaggtggcgactacgggggacatgattttggaggtggttacgaccaaggaggacaccatgaacaccatgagaaaacagtcacggtggtcaagaaagtagcagtaccttaccctgttaccaaggaagtaccatatcctgtagaaaaaacagtccatgtccccgtt

SEQ ID NO: 7191 - DNA, 398 bp, Diabrotica virgifera
  Clone ID: LIB150-048-Q1-E1-C12
acggacgcgtgggcggacgcgtgggtaaaaatggcgatatttcaatcgatgaaaaaatagacaaacttgttggcagtggaaccggagaagaggaatcgaaagagaacgaagtgcctaatgaccaggaagccaaagaggataaggattctgaagataaaaaagagggctctgtcgagaaggaagaagctactaaagacgatgatgtcgacgagaatgaagaggaagacgacaaagaagatgaaaaagaaacttcccccgaaaagtctgatgaataaatattaggattatacaaagaaacgcactgatgacctaattataagaaatcgaaacaccaaaatgattttcaaattcgttattgttttgcccttttatttaaagttgtttacaacttttttgag

SEQ ID NO: 7192 - DNA, 369 bp, Diabrotica virgifera
  Clone ID: LIB150-048-Q1-E1-C3
gaaaaattagtattaattagtcaacattcacttacagtgataattgctaagtaatagcatcatatgcgggatacttaagcagcagagaatatattttaattgtaataataagttaacagtgataagaaacaactgaatcaaatataattttaaaatggaaggtggaccaaatattcaagaaaaggatgatgaacctgtagctccccggggtttctttaatttcctttgtcaccccttaggttctggccataggtttatagctttaatattcatgtgtttcctaagttttggttcctatttttgttatgataaccctgctgccttacaagataaaataaaagaaaacctagatttatctgaggtgcaata

SEQ ID NO: 7193 - DNA, 377 bp, Diabrotica virgifera
  unsure (1)..(377): unsure at all n locations
  Clone ID: LIB150-048-Q1-E1-C5
aaatttttcacaagtatgaacttcactttactttatagctctacatctgtttcatagtcaagatgatatttttaatttccccttgatataaattattgagagaatatagagatataccctcctctgggatttgcccatatatacccttctgacgatccctaataagggtgaaatttacgtaaggacgtttttggtcctctctgaacgaattgaaatgtaagatgtctcttgttttcgtcttgtaccgaattcattaataatagttttactcctatataagtatcgggatcaggatttcgttggatttttgccttgatgaataggcaggtagaaaagtgcaacttttagacttcnccgtatcttccttcattcatcgt

SEQ ID NO: 7194 - DNA, 374 bp, Diabrotica virgifera
  Clone ID: LIB150-048-Q1-E1-C7
tgcgtcacataaagctagtttttaaaggtggttcttgttcatatttcctttggtttttccttagaacatatcaaagcaatcttgtccaacacttctctgatgaaattgtacagtgtaattatcctaaaacttccttttcgatgagtttttcttaatcagtttcgatttttatctaaaatgtatacacctcttcttctaaaggtgtctatcttctggtgatgcgtatcatcagatacttcagcaatacggtatcgtctgcgtatctaatatgaaataacaatataccgtaatattaagaatttcttctgtttaccatacaccaattttcatttttagatgctcattagtcattcggcacctctatttttaatcaa

SEQ ID NO: 7195 - DNA, 387 bp, Diabrotica virgifera
  Clone ID: LIB150-048-Q1-E1-D12
ctcgcgggtcgatacaagcctctacactgacgtcctattaaaacatgtctcataaaattattttcgcggtgtttacaattgttctattaacattacctttcaaagctatttcggcctgtgggggtatcaaaaatgttttaatcgaagtgaaagatagtgagagtgaaagaagtaacatcacattcagtggttgcttggagagaaaaaattttggagggaaaaccattaccgaaattcatataagaaaccaaaatattccaaatataggatgggaatatattacacatttagttagattagatgttttagaactcaacaactgcaaaattaaaaatatcgctagaggagcactaaaaaatttaccaagaatcagagttgtcgaagtta

SEQ ID NO: 7196 - DNA, 405 bp, Diabrotica virgifera
  Clone ID: LIB150-048-Q1-E1-D6
acgtcactgctttgaagtatgatcctaatgatgttaccctttccgaacatcataacttcactgttaccaacaatggacaatctgaaatagaagttgaggtgacatacaccgacagcgatgaccgtgccaatgatcaatacagggtagttaaaccaaatgaaactgtagtaattgagcataacaaagacgctggagtagctctattaaatatattgaacagacattacacagaagtcgctattatcacagccaccggtggaagagtagttcgagacattgaaagaaaaatcaaacaactagtatctgatgaacattcagtaatgctggtgaataatttccatctagcacctgcatcatctgtacttgtcatgcatcaagttggtagatatagcccaagacccatgt

SEQ ID NO: 7197 - DNA, 375 bp, Diabrotica virgifera
  Clone ID: LIB150-048-Q1-E1-D7
aaatcaacaaatcaaccatgtctgatgacgcagcaacgacaccctcaaagcgaggacgcaaagctaatgcagagaaagctgaaaaagtagaaaaagcagagaaggttgatacaaaaaagagggggaagaaagatgcagatgatgaaggtgcatcacctgcaaagaggggtagaggcaggccaaagggaaccacgaaaaagaagagcgcagtcaaaccaaaagccaaatctgccggagcatcacgaggccgtggcagaccaaagaagaaagaagaacccaaggactccggagatgaagataatgacgacaatgatgccggagaagaggaggaagatgatgattaaatgttcagtcttaaaaaagttttgaattttt

SEQ ID NO: 7198 - DNA, 385 bp, Diabrotica virgifera
  Clone ID: LIB150-048-Q1-E1-E10
ctctacagacactcgggtaagtgtgcaatgatgagcctccaatactgtggattggtccttttggcaggtcttttgttggtttccgcccaccctggaaccgactctaaggctgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccataccccgtacacatcgaaaagaaaa

SEQ ID NO: 7199 - DNA, 395 bp, Diabrotica virgifera
  Clone ID: LIB150-048-Q1-E1-E11
cacaggtctaggactcgcgggtcgacacacgcctctacagacactcgggcgaacgcgtgggtccaagttgtgtattctctccataccttgaagggacgcactattttccggaacacccgttgcttatgaatcatcctatacagggtgttattttgcctgcaggttttttgacgaaagatttttatttttaggaaattcatactttatttgtggatcccacaaaagcgtatgacacgattctggtgagaaagttgtgacagtctcttgaacgatcttctgtaaatagcacgatcatcgccgcagtcacacaattatgcaataaagcaacatcagcgagtcgtactacatcaggtagtcgtagtgaatgatgaggaagacatggactacatgtttag

SEQ ID NO: 7200 - DNA, 435 bp, Diabrotica virgifera
  Clone ID: LIB150-048-Q1-E1-E2
cataacttcactgttaccaacaatggacaatctgaaatagaagttgaggttacatacactgacagcgatgaccgttccaatgatcagtacaggttagttaaaccaaatgaaactgtagtaattgagcataacaaagacgctggagtagctctattaaatatattgaacagacattacacagaagtcgctattatcacagccaccggtggaagagtagttcgagacattgaaagaaaaatcagacaactagtatctgatgaacattcagtaatgctggtgaataatttccatctagcacctgcatcatctgtagttgtcatgcatcaagttggtagatatagacgaagacccatgtaccctgctggacatcgcaaacctcaaacatggtatggtcgtaaaactcaatacaatcctggacgtagaccagcatgtaaa

SEQ ID NO: 7201 - DNA, 391 bp, Diabrotica virgifera
  Clone ID: LIB150-048-Q1-E1-E3
tacatacaaagaaaatcttgggtatagactatagagagtattttgcataaaatattccggcagaagaaaatattactgaagtatgtgggaagttcgcaggaatttaaaaattcctgtgtcctttctgtatgatatattatactttccacacatgcatgcacaaaataaaaataagggcgaaaatagtctgcctaatttttgttagtaaatagagagaagactaaacaggtctctctagatgctattttaaagacgtgtgtgttaaatttgatttttctcgacactgaaacattcgatttaataattgtgcgtatataacttttaagagtgtaggcgcgaaatttcgtgccaatgcttttttatatatatacattttttttcaatgggaaaa

SEQ ID NO: 7202 - DNA, 374 bp, Diabrotica virgifera
  Clone ID: LIB150-048-Q1-E1-E4
cccacgcgtccggttcgttttccttaacaccgtgtagcttttattttacctctcattatgctttgtactacctactgcatatttagaatctcctcctgcagttctatattagtgtttctttcagtttataatatccctagtatgtgccaatgaaatcactttcatctgctttgagtctatcaagtttgaacttttttagcattcaggattacaaaccgtaattttagtatttttgttataaatacatgattatttttgatacagaaaactctcttgggatttatgaatactgacctttgcgtgcttttatttccggtaggtacttatctccgtggcaacttcatataaatatacactatccctgcattttggtc

SEQ ID NO: 7203 - DNA, 406 bp, Diabrotica virgifera
  Clone ID: LIB150-048-Q1-E1-F1
tcgatacaagcctctatagtgactcgtactaacgcgtgggctgacagtttctacagtatagttgcagtgttcagtggaaaatattcaattaagatattcctagcgttcagacgtgtgctctggttgattggcgatgcctccgttgacacatttttgacagaaatgttagagaatccttcagattcttaaatattaggaatatatgtaatgttgacgaggctgttatgttgaaaaatgatgctaaattaccacttagttcaggaactgaaattgttattaaattaaattaaatacataccaattcggttaaaataatataatacattaccctttaaaactattccagaaatctttacccaaaaaataattatttaaatcaagaagttatttgcttgtccttcaacgt

SEQ ID NO: 7204 - DNA, 446 bp, Diabrotica virgifera
  unsure (1)..(446): unsure at all n locations
  Clone ID: LIB150-048-Q1-E1-F4
ctctaaccacacacatacacacagtgcttagttaacttttttctgtaaaatcgaccggagtttttgtattagttaataacgaacatggatacccagaacgttgatgaatcagccacatctcccacagctgaatctccaaaaactgagaaaccagaatccacagaatccacagaagccgctacagttctcaacggagaggcatcaaaagatgaaatcgccagcgaagcacccaaaacagaagccgctacacccgtagaggaagagcccaaaaaagaggaacctgtggtagatgagcctgcaaaagaggaagcaaaagaggagccgaagatagaggaacccaaggcagaggaacctaaacctgttgaagaagcagaatcacctaaagtccccgaacccgttactgaatccgctccctctcccccggaacaagaggaacnccgctacat

SEQ ID NO: 7205 - DNA, 303 bp, Diabrotica virgifera
  Clone ID: LIB150-048-Q1-E1-F5
cgtggcaaaattattcatttaatccagttcccatgtacagttgaatttcgccatgttgaggctccctcggtctggggcggggtcaatggtcgtcaaggttcaaaccggagtgcacctggacgtccctcaatccgttgttatcgacgtcatcctttgcggtcaagtgcatgaaattggttggcggctaagtggaggttgtatcgtagttttcgggaaaggtgagattcttgccggcggtgggtatcgtgcatcgcgtttggctgctttttctccgtcgcctgtagtactggagggggagttcgt

SEQ ID NO: 7206 - DNA, 433 bp, Diabrotica virgifera
  Clone ID: LIB150-048-Q1-E1-F6
aacgaaaatcacttccggaaaattaagaatgaaacctttgataacgctctggttcttagtccttgtagcagtggcgataaacgccgaggccaaggagaagaaaagcgcagaagccgatgacaagaaacagaagaaacgtggtctcctcagcttaggatacggatatggtggagattttgataatggttaccacttaggacaaggtggatacggtattgacggtggttacacactaggattaggccagctagacttaggacacactacttctattgagaagaccattactttggttaaaggagtaccagtaccatacccagtagagagacacatcccttacccagttaccagacacgtaccttacccagtaaaggttcttgtaccacaaccatacccagtagagaaaccagtagcctacccagttaaagtacat

SEQ ID NO: 7207 - DNA, 450 bp, Diabrotica virgifera
  Clone ID: LIB150-048-Q1-E1-F8
ctcgcgggtcgatacaagactctaaagtgagtacgtgatatcaatatacctatcaactttaaacagtttttgaagatattcttctttagcggcgattcgattgagggtaaaattgtacatatatctgcgcgcctgcgcacacagacagcatgtagttcattgctaatctttcaagataggtatgtatgtatctgtaaccgtgcaaacaagtcattaaaagaatgtattagtgtttttggtaaatgtattatttgttataattcttgtgtttttggatttgtgtttctctgtagtaaaataatgaaatattatgtaggcataacatttttacactatttgtcgccgtgttgtgtaattatatccgaaacttacacgtcaattacaaggacctcgctggagtagttggtaagtcgttagctccaagattggaaggacgcgggttcgaatcct

SEQ ID NO: 7208 - DNA, 429 bp, Diabrotica virgifera
  Clone ID: LIB150-048-Q1-E1-F9
tcgcgggtcgacacacgcctctacagtcactcgggttacgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttctgctaaaggtggtcacgttattgacgacttggaaaacaacatggaagaacttcttgactcagacgaaacagaaactgaaatggtcgttctggaaaacttttccttaagcccaagaactgctgtcactgttttg

SEQ ID NO: 7209 - DNA, 401 bp, Diabrotica virgifera
  Clone ID: LIB150-048-Q1-E1-G11
aaataatgtcattataataatcaaaatttgcgcgtactatatgaagagcttccacaaaaatgcgttggccgttagtacttcttaagtaacgttggtggggacatttataatacctattcccttttcaggtcgcaaattgtgtcagttttagtctaaaatattataaactgagttgtgctacccttgctcaaaattatttcggtgaaaaatgtcaaacaaaagaaagtggttatcattagaagcaaaaatcgcgattatcgaagagtctgaaaaaaccaaaaagagttcccggatactcgcaaagcaattcaacgtgggaaggacgcagatctgtaccattttgaaagacaaagaggccatttataaatcgtgggaaagaaacggctgctgtgttaagtcgg

SEQ ID NO: 7210 - DNA, 378 bp, Diabrotica virgifera
  Clone ID: LIB150-048-Q1-E1-G12
acgcgtgggtcgttacaagaccctagagtgagtcctatgatttggtcaagaaaccagaagaaggccccgaaatcactattcctactgctgcaccaacacaacccagcaaaccagaagtatacttcatcagatacaagacccagaaaaccgccggaggtggaactggattcggaggtggaagcggtattggaggtggcattggaggcggtattggaggtggtattggaggtggtattggaggaggaatcggcggaggaatcggaggaggcggtatcggaggtggaatcggaggtggaatcggcggtggatccggcggtggtatttcatccagctacggcccacctggcaaatccggtccatactaattttcttactaag

SEQ ID NO: 7211 - DNA, 431 bp, Diabrotica virgifera
  Clone ID: LIB150-048-Q1-E1-G2
cggacgcgtggggggatttagattttgtcattgaactacatttcaagggagagttaggcgaagtgcatgaagtcaatagatatagaatgcgttaacatatttttctagtataagttttttatctgttactactattgcagttgtcaaataactgttaagtttaaaatcacttgataaagaatctttaatggatcatgtaaatgaaaaacatctgtaagtagcagtggtctaattggaccaccaaaataccttaaggttcatgaaatcaacatttggttttgtcttaaaacaaacttttcccttcgttgttccagtttgtaagtccaatttcttcttcttctacggcactacagcccaaattgagctttggcctcctttattttttgcctccacccttgcctgtctgtggctgctccttctcatacacggac

SEQ ID NO: 7212 - DNA, 396 bp, Diabrotica virgifera
  Clone ID: LIB150-048-Q1-E1-G3
ctcgcgagtcgatacaagcctctagaatcactcatatgagcaatgatgagcctccaatactgtggattggtccttttggcaggccttttgttggtttccgcccaccctggaaccgactctaaggttgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaag

SEQ ID NO: 7213 - DNA, 394 bp, Diabrotica virgifera
  Clone ID: LIB150-048-Q1-E1-G7
acccacacgttctgcgtaacgcgtgggttattaacgagcagatccagcaattgatccaacaagttttgtaccaacaaactcacgtaaggcaacaaatccaagtactaattcaacaaggacatgttatcccacaggaactcgtcctttaccaaaaaattacctaccaatatgttgaaagatttcttcaagttttgattaaacaattcgtaaatcaacaaaccaactacaaacagttgatccaaattttgggacaacaaagacacaccatacctcaagaattggtttcccaatatttcgctatgtacacccaattacttcaattgatccaacacggagatattgtaccccaagaattgatctaccaacaaagacaaatccaccaacagatcgtact

SEQ ID NO: 7214 - DNA, 405 bp, Diabrotica virgifera
  Clone ID: LIB150-048-Q1-E1-G8
agtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccacatcagaaaaacttcttccccaaaaacaagaaccattacctgccagcagcgattcctcatcagaatcttcctctgagagcagcgatgagtctggagaaaagaaatcatcctccgagtcctcctcgagcgagaaagaatccagcgaagtaaaaatccaagaaaagaaacttgccgaacctctcccagctatcaaagagccaattaaggaagaagtgaggccaatcgatt

SEQ ID NO: 7215 - DNA, 408 bp, Diabrotica virgifera
  unsure (1)..(408): unsure at all n locations
  Clone ID: LIB150-048-Q1-E1-G9
ctcgtgtttttggtgtgactttttttatcacgggttattttttcgtgtgttgcgctcatcgacaaaccacaagaatgaaacttatcgtaggattattattaatagccacagctctggcatacccagtagcggaaaatgaagaaaaactagcccaaccagtaattgcacaagacgcgaagccagcagagcaagaactaccactaccagaccaacttcttcccatatcagaaaaacttccccaaaaacaagaaccgttacctgccagcagcgattcttcatcagaatcttcctctgagagcagcgatgagtctggagaaaagaaatcatcctccgagtcctcctcgagcgagaaagaatccagcgaagtaaaaatccaagaaaagaaacttgccgaancttctccagcta

SEQ ID NO: 7216 - DNA, 382 bp, Diabrotica virgifera
  Clone ID: LIB150-048-Q1-E1-H1
cccacgcgtccgcccacgcgtccgcagcaaccaccggcttcaagatggcgtaccgaccacgatccatgcaagagagcacccaagaatattcagtggagacgacgacatattatgaaacatacgaatatgaaaccactttctctgtttcggagacatcgaaactagatcatttcgttttacctcctagaactacgatcttagcattgtctcagagcggaggagataaggaagaagacaaaaagtatgtcgtcaccaatcacggaaaagctgatctttttgttgaggtagtacacctcaataaccaagatgatgctccacaatggtttgtggtccagccagaccaaaccactgagatagccattgaggacagtcttgaacaaag

SEQ ID NO: 7217 - DNA, 390 bp, Diabrotica virgifera
  Clone ID: LIB150-048-Q1-E1-H12
tcgcgggtcgatacaagcctctacattgagtcgttatacagcttgagttgtaaaactaaatccgttgtttatatcaactaaatattcgttgattatattaaaatagtatttcaaaagttgatacattccagttcaactctactctttattacgaaatgatagaaatgaggttctttaacaatccttttgaagattatacaccagaagggctacaagaaagtaaaaacaaagtgagtcaaagcataaacgtaaaatggaagtcaactatggaaaacttacagaccttggatttcagtgactatactgtttatacaggtacttccggcgtggctctacttaaattattacaagatcctgacgacttccagaatttaaaggaggttttaaaac

SEQ ID NO: 7218 - DNA, 436 bp, Diabrotica virgifera
  Clone ID: LIB150-048-Q1-E1-H2
cggacgcgtgggtttctatagaatgttgaaaggttcatttctacgtcgttatcaaaatatatcacgagcattatttcaaacaaagtgtattattaccatactcatctactctagtctaaagtgttatccagtagtaaagtattgatttttacagtattattttatacttaaagtgaaaaatggcactggagagtttaaaaaatatagtggttggacctgaattagaaagaataatagatacatcccttggagaattattactattagttctaaaaacttttgaagataatgtgattcaggtagatggagaaaccggagaagaattaccagccaatttgttgttaaaaagaagtattagattgtcaaaatggttaacaagccaaggcattaaagtaggtgattacatttcaataaatagtgaaaatcgattagaatt

SEQ ID NO: 7219 - DNA, 281 bp, Diabrotica virgifera
  Clone ID: LIB150-048-Q1-E1-H5
taatttgttctgagttgaataacatgtttatttcagtttgtttatttactaaaaattgtctagatatactggcaagattccaaaaggatatttttctgattacatcaacgttgactaaagcagcctgaaagtagctgcttcttactctacagcgttaacaaggtacattttagtaatgtaatctggttaccgtttaattttactcgaacatagatgtctctaaagagtgcactaaagttattgtgatactgtgagattatctggcaataaacctttctgga

SEQ ID NO: 7220 - DNA, 358 bp, Diabrotica virgifera
  Clone ID: LIB150-048-Q1-E1-H8
atatattatttgctttaatcaattttaataaaaatacaatatgttgaaatttgtatgcatttcttaaatacatgttcgttttttaatagtttacattgttaatcaatctaaaattaaaaaatatttacaaaaaatctacaaggggttcccaagcacagtgtatcaactaatattaaagattttaatttagattttcagtctcatttaagctactttgcacatatttcaataaatttgtacagccagtattaaacacgataattcagatcgagaaatcaacaactataatatattccaactagcatttcaaagtaaaatacggcaaaatatatggacaacatttttgtatcattgacgt

SEQ ID NO: 7221 - DNA, 384 bp, Diabrotica virgifera
  Clone ID: LIB150-048-Q1-E1-H9
acggacgcgtgggcggacgcgtgggaaaaatgacaacaatgacaacaataaaaaccaacaaaattaaattagtaacaataataaataattaataaattataggaactagtactttacttcagttactgaattatggatgcttcttttaatttataaaaatttataaagtaatcaaacatacatatggtgcatctcatcagtcaatttatcgaaatgaaaataaaaaaggatttacagactttttttctttttgatagttgaggtagacaaaatatatacctatagaatagtttttgctacatacttctatgtagcgaaaaagcttaatattaacattacacatatattttttgaaatagcacaattattgcaagacaagtgtga

SEQ ID NO: 7222 - DNA, 395 bp, Diabrotica virgifera
  Clone ID: LIB150-049-Q1-E1-A11
atcgtcttgaagatcaaatgaacactaaccaaatcttgaaccaaatctacagacaacaacttggacaatctccattgaaccgttatttggtaaacatgagagcgtgtaaatggacaaaaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttaccatcaaaatctcattacacgtgaagttgaacaatacattgttaaaggacaagtagttccccagcaacttgtttaccaacaaagattggt

SEQ ID NO: 7223 - DNA, 368 bp, Diabrotica virgifera
  Clone ID: LIB150-049-Q1-E1-A3
agcggacgcgtggaaaatatagagaataatagcttatctaggctaatgtactttatattttcctttcgcaccgtagattcaacagctgagtagcaaataaaaatatatgattcataaatcatatattttgtataaatcagtgacaactgatttatatatgacgtttcgtatgtatgaaaatacgtataaatcgtagcgctctcgcagttgtactatggtttttttgctgtgagatcgagaactttacaagctttttaagtgagtggttcaaaaacgatcgaaacaacagcgttttgattgattttattatcatcaaaacacataaatgtgcgatagctctcctctttccgagcgagtatattataaaa

SEQ ID NO: 7224 - DNA, 368 bp, Diabrotica virgifera
  Clone ID: LIB150-049-Q1-E1-A6
cccacgcgtccggcaattttaagtaccttcggtatcttgatgttttttatatttttgctacgtagattagatttttcgatggtaccaggctgaaaagccgtcaaataatttgttattgacagtttgtttgtttaaattattgtatcttctaaaccattaaagatatttaattttaccaaaatgaaaatggttccttgtgaaaaaattaagaaatagcgtctggtaaactttgatacgattgttagaaccggaattataacaaatttcatgaaaaacaattgcaaaataggcatttgatgtagtagtacgttctttaacggtaaaatattgcaaaacctctaaattttacagaacttcttggattgaca

SEQ ID NO: 7225 - DNA, 215 bp, Diabrotica virgifera
  Clone ID: LIB150-049-Q1-E1-A9
taatgatatctaactatttcgtcatctacaaaatgagtatgctatcaaccttgttaatattgacaatctgcgtcagagtgtatgctcaaaggtggcgcattgaaggttgccctcctggtccttcgttttcctgtcgacgggaagttgaatgtgatctgctcaaatgcggtaggctaccaccctgggccgtaggataaatattaggtagtcttcct

SEQ ID NO: 7226 - DNA, 364 bp, Diabrotica virgifera
  Clone ID: LIB150-049-Q1-E1-B1
cgggccgacccacgcgtcagggtattgttactgatttttgccctagcagtatatgcacagggagcaccagcgcaaaagggttggttgaaaggttgggctagcgtacccaatgttccactggtgaaacatggaaacaagagctactttcttggagttaactacaaggcaaacttccaagaggctcttcaattctgtgatgtcctttacatgaaactattgaccattgagtcacaagaggaaaatgatgctatcaagaaaatgattttggataataaggccagcggtaccgaatactggacttctgctgccaacttcctggacaatagaaacttcgtctggatgaacacaggaaaaactgtggaat

SEQ ID NO: 7227 - DNA, 319 bp, Diabrotica virgifera
  Clone ID: LIB150-049-Q1-E1-B3
aaccaagcgtcagcagtgctctacttgatttaatacaatgaacaatacattggtagttttgtgtcagtgcataataatttttgaaagtaaagctcttacatttcaaggttcaaaatatcctcaaactcaatcaacctcagtcagtgtcaaactacagacagtttaaaagaatcagtactatagttggatttgcctttacaggaaccttctttgaagcgttgctacactgtaaactacccaatatggacataatgagtgttgagacctaagcagaaaatgagtttccttttgataagataaaggcgccatctggaggtga

SEQ ID NO: 7228 - DNA, 308 bp, Diabrotica virgifera
  Clone ID: LIB150-049-Q1-E1-B8
atcagcccacacgtccgcccacgcgtccgcccacgcttcagcccacgcgtccgcccacgcgtccgaattgttgctaccgttttgtgcgtcgaaactgccgcctacgcagcgccgactaattagcatattgaagctagcatgacaggtcatgagcattgtcaattccaagagtcaactatacttgactaccaagtatgggaaaaacttaaacatggctataaagcagataacacaaaactgccagaacataccctatgtttgaacgtatatactggacttcaataggagaatggcgatattaacgtgga

SEQ ID NO: 7229 - DNA, 374 bp, Diabrotica virgifera
  Clone ID: LIB150-049-Q1-E1-C1
agggcacggttcatacatccataattaagacgccaacaaaagatgaagaagatgaaagcacgggtatagacaacataattgacacatctgagctagaaaatccaccccttccatcaaaattcgatttagaagatttcggaaggaatataaaaaatatacaaagctatgctcaaaagataatatcgttacaagaaattctcaaacagaaaggaaaattaagtccagctcaagaagcagcgtataaagaaaatatggacagcttaagttcctctgccttaaaattggctgaaatacaagaaaaaagcaatcccatcggactagaaaacagagaacgtataagtgcttggctggaaaacaagaaaaattcaaacaac

SEQ ID NO: 7230 - DNA, 247 bp, Diabrotica virgifera
  Clone ID: LIB150-049-Q1-E1-C11
ttccctggccaaaccactacgactgagtcgtattagtcatcattaacaccgagttcggggatgaattgttcgatgagatgaatatataagttaagtttgataaagatgcagagaagagggattagtcgaggacaaagatgaaggattagaaaggttttaatatgctccttggtttggacaaatcaaatatcgactaccagcatctaatggaggagacaatgtccgataatgcaatggacgtcgaaaa

SEQ ID NO: 7231 - DNA, 241 bp, Diabrotica virgifera
  Clone ID: LIB150-049-Q1-E1-C12
agtttgcttacaaatattgctgagacacactaagactggggttactcatattccaacaaatttacacaccttgcatttggactcacgttcaaccgtcactgcggggatgtacgatcctaaggatgataccatttccgcacatcacaccatcactgttgccacccacggaagatctgatctatagattgacgctacagacactgatagcgctgaccgtgccagtgatcaacatgacgtagtc

SEQ ID NO: 7232 - DNA, 401 bp, Diabrotica virgifera
  Clone ID: LIB150-049-Q1-E1-C2
agcagcaaccaccggcttcaagatggcgtaccgaccacgatccatgcaagagagcacccaagaatattcagtggagacgacgacatattatgaaacatacgaatatgaaaccactttctctgtttcggagacatcgaaactagatcatttcgttttacctcctagaactacgatcttagcattgtctcagagcggaggagataaggaagaagacaaaaagtatgtcgtcaccaatcacggaaaagctgatctttttgttgaggtagtacacctcaataaccaagatgatgctccacaatggtttgtgggccagccagaccaaaccactgagatagccattgaggacagtcttgaacagagcgtgttgaaagtgagcaacaacagttacgaacaggaggtat

SEQ ID NO: 7233 - DNA, 401 bp, Diabrotica virgifera
  Clone ID: LIB150-049-Q1-E1-C6
aggtgatatgccacctagtgattcagaatctgataaaaagctagagagtgatgatgataatgatttttaccaatcagataatgaagagcatacagatcctggtgagaaatgggttgattatgtggactgctttggaagaacacgaaaatgtatgcagaaagatctagaatatctaaaatccaaagataatgaaatgaaaaaagtcgtagaagtgaaacatcaacagttagataatcctgcatcacaaaatcttgaaaatgatgacaactttgttcaatcaagtactgaatcactggctgagaatgaagtaggtcaatcagaattgctgtctagtgatatgagaagggaactgctacgacaacagtgggaaaaagaggaagaagagctgcgtaataaatcag

SEQ ID NO: 7234 - DNA, 323 bp, Diabrotica virgifera
  Clone ID: LIB150-049-Q1-E1-C7
aactcacatatcacgtatgcgcacctgtcagactgagaatttatgttgcttagcacataaagtataattactaactgatattgtggaatgagctatttttagctactgatttgttataacagcagagattactttgaaggtaatgtaattcgtcagactgattgtaatattcaagaatcgtgtcacatagcactttagattatgaggtatcgttgacgttcgtggaaaatcatttgttctgattctgtcatgagtgttaagtaaagggaacacacatttcaacagaaacgatagatcgttgctctgaatatcaatttgtgttg

SEQ ID NO: 7235 - DNA, 335 bp, Diabrotica virgifera
  Clone ID: LIB150-049-Q1-E1-C8
gacccacgagtcaacggacgcgtggttatttaataacaatatatttataattaaatatctttacattattaatattaaatatttttagggatgagcttaaaaataacattttactaaaatttaactttcaaataacaactaagattaaaaattttcatactttaaaatatgttactatttacttttatatattattactttcaatttttataaattttttattaaaatataaccttacattatctaaatttagtaatcatgataacattagtattaacaaactgtatatttagcaaaaatatataggtttaatacaggaattcggcaacattttt

SEQ ID NO: 7236 - DNA, 346 bp, Diabrotica virgifera
  Clone ID: LIB150-049-Q1-E1-C9
ccaccctggaaccgactctaaggttgaagccaaggtatcttcagtagccgagaagaaacaggaaaaacgtggtcttcttgatctaggctacggtgggggacacgactttggaggaggacttgaacttggagggcatggtttggatttgggtggacatggtggtttcgacggaggatatggtggagggttaggtggagggtatggtggattagacgaaggtcatgttaagcacattaccatcaccaaagaagttaaagtacctgttcctgcaccatatcccgtacacatcgaaaagaaaataccagttcgagtgccagtcaaagtacctgtacaagtagatcgtcca

SEQ ID NO: 7237 - DNA, 304 bp, Diabrotica virgifera
  Clone ID: LIB150-049-Q1-E1-D10
tcccgggcccacgcacgacgtctagagttatggcaacttccgaggacaatcaacaggaaaatccccagtcaaagttatcttaagggacatatcatcctgagggagcttcactcggcagtgattgcccaggtccccattcaacgcaatgctacgcatcttagccaatatccaacaccagtgtggcattcatgaagaactactgagactataagcttggatgcacgaaatgatcatggattgcatgcctatctacaaaccaagacattcgcaacagacattgcggagatctccactacaaacctca

SEQ ID NO: 7238 - DNA, 411 bp, Diabrotica virgifera
  Clone ID: LIB150-049-Q1-E1-D2
aggttagtacaggtctgacgaaggatttatagattttgatcttggaacttcctgtaagattttttgattttataagcttatccagtgcgaatagacagcgatttgctgattgaattctgtcttttatctcttcagtaacatcgttgtcagctgtgattatggcccccagatacttaaaacgttgtactctttcgaaatttaaggtgttgaccgtcacattttgtcctatcctgtctcttcgtgtcgttctatttatacaaataccatttccatatatttttgtaccatcctccgtgtttattaattcattgggaactgttcctttttccatttttgctatatgtccgagccatcttaatcttagtactagagtacctcacaatttaataatccgggtgtcaaaatgcttag

SEQ ID NO: 7239 - DNA, 406 bp, Diabrotica virgifera
  Clone ID: LIB150-049-Q1-E1-D7
agcccacgcgtccgcccacgcgtccgaaatgaagtatctgtatttgttttttattgcttatatcttcgcctacgtttctggatctcagcttaaaaatcaacaacatgtttgtaactgccaaaagactttagaaaccatttatgctgatgtcctccagcaagagaaagctttaaatcaaacccttattgatatttctgttcttgaaatagagcttagacaactcgatgatcttcttgaaggacaagaagataagctaatagacatctcggctgaattagcagcactaactgtaactaagaactacattaaccgtttacttgccgatggaagccaagccctccaatgcatcatagacaatctcaaagaagtttgccatgattcacaagatgacctcgataatgatgtc

SEQ ID NO: 7240 - DNA, 318 bp, Diabrotica virgifera
  Clone ID: LIB150-049-Q1-E1-D8
aataattcgtattaatgcacacgattttggggctaagtttgtccattgaaagatttgcatattaagcatgtattaatgttaaacaagagattcggtgttaaaattgatattttttaccaagctgtattttggtattatttttgcaaccagggtgtgtttactgcaagctgaacacagaataatcagtgattgtatgtcagttttgagtacatgttcaatttgcgtgtatttaatttctatcaaaaactagactataagctacatcccagaaaaaatttttttttacgtttttttcagtatttgtatgacgtgaacata

SEQ ID NO: 7241 - DNA, 405 bp, Diabrotica virgifera
  Clone ID: LIB150-049-Q1-E1-E12
cccacgcgtccggaaggaaatacaagttcccgattggaaagtgatttctaaaccaatatggaaggaaattcaagttccagcatggaaagagatacaagttcctgattggcaagaactgaaggttccggcttggaaggaaataaaggtgcctgattggaaagaaattcaagtgccagattggaaagaggttcaagttccggcttggaagcaaatttggattccaatctggaatgaaattcaaatgcctgcttggaaagaaatccaagttcctgattggaagaagtcatatgcaccataatgggtataagaatgaatccactgagagcactatttgggcaaggactaccacggcagtgaatatacagctcatgacatctgggacaataaactcatctggaaacctgt

SEQ ID NO: 7242 - DNA, 222 bp, Diabrotica virgifera
  Clone ID: LIB150-049-Q1-E1-F11
ctcccagtccaatacactactctacacagactcatagcaagcggctgccctttttttttttttttttttttttgcttttttttttttttttttttctttcttttcttttttttaacattaaccggggcaccaaaattattctagatctatagccctttccgtacaacaccttttagtacatatactatacaaaccgacttggcttaaacgcggttcaaactc

SEQ ID NO: 7243 - DNA, 364 bp, Diabrotica virgifera
  Clone ID: LIB150-049-Q1-E1-F3
agggagtgggttgaggttgaggaggtggtttcagcggtttgtgaaagctgaaatcgcttcaataaatttacaaaatttttaaattcctttaaataatagtttgatgtatttttaacaaattaattgcaaatgaaaaaattattcttcaaaattataattatgtcaagaagtatgagaatacggctaaaaaatttattttagtgactcttcaatagtgctcaacattgattaatgtgattattatttaagcagtaccattcacatttacatattcttctctcggccgcagtagaggagattttgattatccaataaacttacgatggaggatataatatcgtcagtgcatcggccgatgtaacat

SEQ ID NO: 7244 - DNA, 416 bp, Diabrotica virgifera
  unsure (1)..(416): unsure at all n locations
  Clone ID: LIB150-049-Q1-E1-F4
aaaagcaatagttttaagtacttgggatcggtattacagagtaatggagaaatagatggagatgcatgcagtagaattagggctggatggatgaagtggaaggaagcgagtggtgtgctgtgcgacaggaaaattccaatgaagttgaggggaaaattctataaaacagctataagaccggctatgatgtacggaactgaatgttgggcaatgaaaaagaaagaggaacaacgaatgcatgtggcggaaatgagaatgtttagatggatgagtggagtgacaaaaaaggataaaattaaaaatgagtatattaggggaagtctangtgtggcaccaattgatgccaaaatgagagagcataggttgagacggtttggtcatgttcaacgtcgagacgctaatcacccaatacgaag

SEQ ID NO: 7245 - DNA, 70 bp, Diabrotica virgifera
  Clone ID: LIB150-049-Q1-E1-F6
aaatactatttaataattacgcatcaataatatagcaaactcatgatatctgaaagattaggattcatat

SEQ ID NO: 7246 - DNA, 246 bp, Diabrotica virgifera
  Clone ID: LIB150-049-Q1-E1-F7
agcccacgcgtccgcccacgcgtccgctatttcagattgtcctttgttggtaacagtgaagttgaggttacatacactgacagcgatgaccgtgccaatgatcaatacagggtagttaaaccaaatgaaactgtagtaattgagcataacaaagacgctggagtagctctgttcaatagatttaatagagctactccagcgtctttgttatcacagctaccggtggaagagtagttcgagatattg

SEQ ID NO: 7247 - DNA, 309 bp, Diabrotica virgifera
  Clone ID: LIB150-049-Q1-E1-F8
gcacgaatcaacatagagtcgtaatctggcgactgaaattagatatcggattggaatgagactgatcttaatacaattcatcattcatacatcttcatatcatttttcacaggactttatgagcgccgtgatttaactttttatgggtatgtgcgagtttttccagtttgcttttcaagattctagtccataccgcattggggtgtttgttcagggtctgtgccgttagagcttttgccaacccaggaagatcaggtagtgctcagttcgacatttggtggcaacatttgactggacaccatttcttct

SEQ ID NO: 7248 - DNA, 324 bp, Diabrotica virgifera
  Clone ID: LIB150-049-Q1-E1-G10
cccgggccgacccatacgtcaagcatcataaaacgccttcaagatgctccgcgtacaatctcaggaagttagcacccaagaatattcagtggagacgacgacatatgaaacatacgaatatgaagggactttctctgtctcggagacatcgaaactagatcatttcgttttacctcctagaactacgatcttagcattgtctcagagcggcggagataacgaagaagacagaaagtatgtcgtcaccaatcacggaaaagctgatctttttgttgaggtagtagacctcaataacggggatgatgctccacaatggtttgtggt

SEQ ID NO: 7249 - DNA, 377 bp, Diabrotica virgifera
  Clone ID: LIB150-049-Q1-E1-G11
cgggtcgacacacaaatccgcggccgcgtaggaaaaaattatgggaaaagacaggactaaagtcatttagagtaaatatgccggtaaaagggatagagcagaattgcgcaaacataagggattcggttaacttaacggtacggtctaaatgtgatagttttcaaatggacagttgtttcttatccattgataaaatttctgacggtctaccgtcacatagcatggatttaggaaatacttttaaaatttcggaaaatattacgctagcgggtactgagatttgcaaaacaaataaaataagtttgctgctttggtcaactgtattttgggacttactttgtcaagggcggttcaggttgaataaggtaggacctttt

SEQ ID NO: 7250 - DNA, 392 bp, Diabrotica virgifera
  Clone ID: LIB150-049-Q1-E1-G4
agccaccattatcagaaacagaaaagaaagcgataataacggagttagagcctgtttatagagaaaatggggtattatctagaactatggaagaagcagcaaaggttaaacctaaaaagaagaaagttacaagaatcaaagagttagagaaattagacaaggaattcgaagaattgaagaaatctgaacttgaaaaagttgacgatgcattcaaagaaaaaccaaagtcgaagaaaaaatctaaacctgtcttaatgaaaatagttaaagtagagcaggtagcacaaaaaccgaaaataatcgaaataaaagaagaacctattaaccttgcggatatcaaattgaagaagtccagagtgcccgaaaagaaagaagaaaaatcggtaaaaata

SEQ ID NO: 7251 - DNA, 342 bp, Diabrotica virgifera
  Clone ID: LIB150-049-Q1-E1-G6
agatttgtaaacaaaggaaaatgtggatattgttattaaaatttttaaacaaaataaataattcaatatgagcttaactaaaagtcaccacgagcaattggaattatgtactaccaggccggcatacagacaaggacgaaaattaactgcagtcaaggtttacacaattaatcaggaatcccaacatctctacatctatggtgtaccttcactcaaattacatcatgagctaaaaactaaatgtcttaggtatggaaaagtggcatctatagctgtagtagaagacgcaaacaatgttccctttactgaatgttaccatatcgagtataacagaatacagtc

SEQ ID NO: 7252 - DNA, 308 bp, Diabrotica virgifera
  Clone ID: LIB150-049-Q1-E1-G7
agcccacgcgtccgttcgtttttaaatatatctaattttttaagaaataaattaaatttatttattaacaatatatttataattaaatatttttatattattaatattaaatatttttagggatgagcttaaaggtaaaattttattaaaatttaatttttagataaaaattaggattaaaaattttcatattttaaaatatgttattatttagttttatatattagtatttttattttttagaaagtttttattaaaatataaatttagattagtttagatttagtagatgatgaataatattaggt

SEQ ID NO: 7253 - DNA, 320 bp, Diabrotica virgifera
  Clone ID: LIB150-049-Q1-E1-G9
agcccacgcgtccgcgaaaatgttgtctgggtcagaagatatagatgtattaatactatgagtttgatcaggaagatcactaagactagtattggtagtaacgtggaataatcgttcagagtatacaaatcagaatttgtaaaattagaaggtgttacaatataagagccattactgttactatccaccacaagttggtcattggtaagttgtgaaaacacagattgatttgacaaaataatattgttatttactctacgtgttataaatttaggtttcttgatcgtgtcaggaagtttcctagattgtccactcctatg

SEQ ID NO: 7254 - DNA, 409 bp, Diabrotica virgifera
  Clone ID: LIB150-049-Q1-E1-H12
agcccacgcgtccggtcgttctctagccgcgcacagtgccaaactcatcctcatctcgcagcagcatgttcggaggtcttgaccccactgggctatattgagagattttgtgccatttttaacaagttctttctgatttttcgtaaatttaaacacgacattttcgcaatcatggacggagacaagttagatcctaccggacagtactagtgtgtgacagttaacgaaaaaaagacttttaacgatgcagaaaacgggaggcaagggcctagaccccacaggactatactaaaattaaggatgtggccccaccgaggcaacggtggacgacaaacttccagtttgccgcgtaaaagactatgatcgtgtttcgacaaatacacagattaacatctcactgccacacaag

SEQ ID NO: 7255 - DNA, 402 bp, Diabrotica virgifera
  Clone ID: LIB150-049-Q1-E1-H7
atcagcgcaatctctccggttagattacaagaaataaagtattacaagaaatagcaacgacctaagaaaaagtgaggcgaattatccaactgcttgtctgttacactttgattggaactacaaccttatctgtgtgaaagtgatagttggcgattgtcttgtttgaatcggttcaggtggacatttcttcagttaactgtaaacttctgcagaaactggaactcaactcgctgaggcctaatcgctggtcaggggattggtcattgaaacgtgaaagtgaatttcacacacaaaattggaataactgttaattggactcaatataatgaacacattagcaaaaaagtctacatgcaggtgaaaatgtcaacacaataggtttctacaaaacaaacatggctc

SEQ ID NO: 7256 - DNA, 408 bp, Diabrotica virgifera
  Clone ID: LIB150-050-Q1-E1-A11
gcgtccaaatggattatggagtccggcactgatatcgaataagcacacatgctttttgatcgatcctgacagatagtaaattgaacttacaaaaaccaatcataggattcttagactacgttaacatcaagtataatagtgttagttaagtgtgtatagaacaacattttctgtgagtacatatttttcgattaataggtaattcataaccaactgaattttataaaaccgtcaataaacaacaccagtcattgatcgacaccaattttttgtcgttaaagacaattaccaaaatccgaagcggaacaggtccgtacttaggaaaatcaaatggtgttgagaaatggaattcgacgtcactaataatagcgatgaatcattatcgcaatccacatcacaaaaaccttt

SEQ ID NO: 7257 - DNA, 411 bp, Diabrotica virgifera
  Clone ID: LIB150-050-Q1-E1-A3
aaacgtccggaaatatatgaagtgggggaacttattaggattaggactaattagtacagataactatgggattggacaaagtactatggacgtttattagagtaaagggggatgataatgtaagtggtacacaaattgaagatagtcaagtgagttcgagaaccagtagagagactgtaaactcgggaaatgctttactatcaaaaatatatacaagaaagatccgatggagggaaggacaatattccttaatcattataagtgcagtattaacagttttcggattggtgcagatactatttcctccatttgatttactcctggatttacgaatacgaatgacccctggtcttccagcatatgaatggtgggtggttccgccaaaagatgccatagttaaaatataccttt

SEQ ID NO: 7258 - DNA, 397 bp, Diabrotica virgifera
  Clone ID: LIB150-050-Q1-E1-A4
tgaaatgtcatacctttctaaaacttccgaactgtctacatcatgtatctaagatacataatgactatacctctgtaaataatcactaatactaaagtgtaagtaatcatgccaatgggatgaactatactgaagctataatactgctattagtttcttcatggatattaggaaattcctgtactaattaaaacgtctttcacttgtaaactgtactctgcaagggattacatgttttcccagctactcatgagatcattaatggatattacattgatttaattatgtttaagtgctacataagttaaactttcagaggcacaaaagataaaactcgattaataaggaaaaccactgcatatcctacaccagtttactatatccatatcatcatgtg

SEQ ID NO: 7259 - DNA, 388 bp, Diabrotica virgifera
  Clone ID: LIB150-050-Q1-E1-B11
gttaaaatatggcaggatcgggcagttatactgtcaataggagaaaagatgcctccttcaagaattttatttgtgcccttgtggccttcttggccatgttaatattaatctcaattctactttgggctttaagaaaccgaggcagtggaagtgagagtctattatccacaacgccagttccaaccaatgacacgggtgaacattcagcacacttaaatggatttataacaggcgaaaaaagtaaaaatgtctctacaacaacccatagaaacacccacaagccagaagaaaaagaccctaataaccaggaatctgcaaaaacaccagcatttgtaccaggtacgactacgcttgcttcaaaaactagtaataaagtggttactactgg

SEQ ID NO: 7260 - DNA, 399 bp, Diabrotica virgifera
  Clone ID: LIB150-050-Q1-E1-B12
accacacgtccgaaacaatgcattttggtgtattgaataatacttatagttaaagtgtaatgtaacaatagtaacaattgatatattagagattgttaaatatggtgtctggccctatagatgtttccgttctaataatagataatgacacttgtttaattaacaaaaaatctaataaaattattagtaatgtgtatgaaggaattccagagactttagtactgaatgttgtgtcatggctgctacttattctgctatttgccattttgaggaatagagcttgggattatggaagactggcattggtacatactgaaaaatggactcaattattttacaagaatacagatgatgcagttgctgtagaagaatcagatcatgaggtgtcgttgatacctg

SEQ ID NO: 7261 - DNA, 416 bp, Diabrotica virgifera
  Clone ID: LIB150-050-Q1-E1-B2
acccacgcgtccgtttttattttacatgtacatggctgcctctgccttctcgacattttttaggaaacggtgttgtatactattgacgtacgggcgttgttgatatgatttgattgccgaaaagccggttatttggttcttgaaccgggtctgtgtttctccggtttgttgttttgagggatttccgatttgttgtcgcgaatatcttgatttgacagattggattctacatcgaattctagagtagtttctcgcgcatcgaaggatgacaaaaaaatcacctcaagctgcgacccatctacctcaacggcctccaccgcgagtggtggcagcaacgctgccggcggaaatagtggtgctgccgcctcaacatcgggtaaagcccaaaagaacgaaccgatggaagtgaagacttc

SEQ ID NO: 7262 - DNA, 176 bp, Diabrotica virgifera
  Clone ID: LIB150-050-Q1-E1-B3
ctcatgacgttcgcaatactattgctaacagcgcttatgaactatagtcccatcattgtgtctaaatgtactgtatcctcactatgtccgaattccaacctatgccatatggtattatgatctagccgctgcatgagtggcatcaggacacaatgtcccgatgcttagtcctcatc

SEQ ID NO: 7263 - DNA, 416 bp, Diabrotica virgifera
  Clone ID: LIB150-050-Q1-E1-B4
agagggaaaccaaatatgaagctatcgtaaaaaaaagtacaaaggagagttggcagctacaggttagaattttgaagtacttgaaaacatcagttccatttttcagttttattccatttggtctcgattctctgggatattattcctcttcatctgaatggtagtagtgttctctatatggcaagcctcattggtggatacagaagagattaagaaacagtaagattttaaatattgcaaacattggctaatgttttttagaatgtatttgaaaatgttatatggattatctaagttagtgaactaatcaaaaaaaaggaaaccaaatatgaagctatccttcgagaagaacaaaggagagtttgcagctacaggttagaattttgaagtattcgaaaacatcagttctatttttc

SEQ ID NO: 7264 - DNA, 398 bp, Diabrotica virgifera
  Clone ID: LIB150-050-Q1-E1-B5
agctctattaaattttgtacataacgtttcttttccagaaaatccttaatttgtttatattctaatcttgcaaaaatttttagtagtctgatttctatagttaatttttgtattatttcatcattagtgagtttctgggaacaccataagcgttttcaaactttatagttataactgactctttgtaaactttaagtgattctttgagcttccgtgtttcatttaataacttgtacagagtctctaatagtactttaattcattattaagctactatgtaatatgcaatcttatgtaaccactgcatacgtttgttccaaaactttgattgctttcgtgatcgtgtttgtggttgtgttttccaggttatttccgctctttagataacttccagaagt

SEQ ID NO: 7265 - DNA, 406 bp, Diabrotica virgifera
  Clone ID: LIB150-050-Q1-E1-B6
aggcctttaaagcggcatatatgcggctttaaaggctccctaactgaaccttgtgtcagttatatatccaatatattttgtactatagttttgtaaatttgttttgggactggaagagatttaactagtattaaaggttacgaatgtgtaactagtggcaaagtacaggttttacaggtttaattgatgtttgttaactatagatctgcaaatatattttttgaattattaatttatgttgactaaaaatatagtgaagggatacatggcctagtctagtaggacctatgtgcgaagtcacctactgtgtttatacaagaaacttaatctaaatatcttttttgtcgttaatatcttataaggagtgatttgatagtactgtagctagcgcatttatagaaacatt

SEQ ID NO: 7266 - DNA, 365 bp, Diabrotica virgifera
  Clone ID: LIB150-050-Q1-E1-B8
aactttatggtctcatcgtcaccacttacctctatattagagcttaagcgcccagctcccctaaattttcatctcctaaacacagcgtaccaaaagttgcgcatcgcgccccgatcattttgtttttaatgtctacatgtaaaaataaaaactgtataaatgttagcaggtgatgaaagtgactgaggcgggcaatgtgaataatttagttatgatggggcccgtatttttcgcgtacggggcaaaacaaattaataattttagtaaaaaagactgggcctcttcatcgctgctgtgtctacacacacgactaataattccttatttccacattcatggaaccggtccagttttcttgacaagtt

SEQ ID NO: 7267 - DNA, 410 bp, Diabrotica virgifera
  Clone ID: LIB150-050-Q1-E1-C1
gtgccttaaggtaacagatcgaagatgaaagcgtttttggtacttggatttgtggctttagccgtcgccacgagcccaccagctcccactagaggcgagaagaaggataatgccaagcctgttgtggcagaaaaatccaaacgtcacttgggaggtggattctaccaacaatccttcaacagtattccacaaacttactcatcttcatggagcagtggtccagtagtccatggatacggctacaaatacaactataactcaggaccagttggtcagtattctgcatcatcatattcctcacctttaagttactctgccggtggattatctgctggaggtttatctggaggccaatactcatctggactttcttctgctggattagccggaagttattcttctggtctttc

SEQ ID NO: 7268 - DNA, 393 bp, Diabrotica virgifera
  Clone ID: LIB150-050-Q1-E1-C10
accacgcgtccgcgaactttgagaaaaaatcacagtttgattggtacatccggtatacaatgacaatttacctgtctagcagcaatattattacagcgatattgttcatgaataaggctacatgttaaaaaagtcatttggatcgaacagcaggtttggtaaattcgagacatcaaaaatgatccgtttttgaggtggtgcgttaatttcttggagaagtatatttagatataacccaaattttttgacttttaaattgtagggcgttgttgaaaattgtctaaaaatctttgacttatcgggcaaagtgcgttcccctgttctggcgactactataattattctcggcgcgcatgtgcctattcgttgatagtcctaattttatattacaaa

SEQ ID NO: 7269 - DNA, 417 bp, Diabrotica virgifera
  Clone ID: LIB150-050-Q1-E1-C2
acgacgatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactataaccaaactgatattcttactgatattttccgtcagtatgaaggtactcttgacgacaccaaatactacagccttcttaacagaatccaaatgttagttgaagctggactcattaatgaaaccatctacgat

SEQ ID NO: 7270 - DNA, 379 bp, Diabrotica virgifera
  Clone ID: LIB150-050-Q1-E1-C3
gttagttcagggagagggtcatatcactattttgcacaacgacatgatacacgaattgactgataatacaactataactggagctttgggatgcaggaatctggctgtgtatccatctaacatcaagtagttctaatgatgagccctgtcgtcgagatcatgctcagtcgtttaacacagtgtatgctaggttactcacgttcgtacagcagtagcgagtacaatagcagatgtcatagcactcagtgacattatcaacgatccttctgtcatggatcatttgacaggatacatatataccgcaatgaatatgcaaacggcaattgccaatactgacagtactatactcagtggagcaactggtaaaggatgtaatttc

SEQ ID NO: 7271 - DNA, 266 bp, Diabrotica virgifera
  Clone ID: LIB150-050-Q1-E1-C5
aacccacgcgtccgctagtgccagtggcgtgctggccatataaatgaatcggtgcaatcaccgataggccgcggcctcttgaggccggtcaaataggttcataaaaaattttagatataactaaaaaattattttttttaatttataatcgaatgataattttgttaatagtatctattaagaaacatttcaaaaacatttattttttttttaattgtaaaatacaagttaagtaggtaattgaataatactatacacataactag

SEQ ID NO: 7272 - DNA, 415 bp, Diabrotica virgifera
  Clone ID: LIB150-050-Q1-E1-C7
ggggaaatgggggctagcggaccaaaccgtacatacctatatttggtggcaattgccgctaatatttcagtctttgtctgcggtactgcattcggatggtcatccccagtaatcccccgtttaaagaatttggacgctagcccgttagatcatgttatatcaacatccgaagagggattgatcgcttctttcctaccgctagcagccgtcttgggacccgtcctaggtggaatactggcgagtaaaattggaaagaagctgacactaataattgcagtcacacctttcatcattgcattcatcatatttacaattgcgacaaaaatagaactattctactttggaagatttttatgtggattagcatgcggtatgacttatgtcaacatacccacttatattgcagaaatcgccg

SEQ ID NO: 7273 - DNA, 418 bp, Diabrotica virgifera
  Clone ID: LIB150-050-Q1-E1-C8
cccacgcgtccggatgaaggtattagttcttctttctttagtcgcattcagcgctgctctaccaacacttcttggtagaaccgctctggtcaaagaagatggaactgttactctcaccgactctagaggataccaactggtaatcctcaagagtgttaccgatcccagacaagtcgaagttattctcaggagtccaaacacaagaacccagatgttccaagttggggaaccacttagaactagagaaactatcgaccgtactctcgttggagtttcagcttaccaaaactataaccaagctgatattcttactgatattttccgtcagtatgaaggtactcttgacgacaccaaatactacagccttcttaacagaatccaaatgttagttgaagctggactcattaattgaaacatc

SEQ ID NO: 7274 - DNA, 375 bp, Diabrotica virgifera
  Clone ID: LIB150-050-Q1-E1-C9
accaaacgtccggtaaaagtgtatgttgtgatttttctcttgctcaccctagccgccatgggattctagttgcgaaaaaccttgcacacgcaagtgtgccttacaacctagtaaatatgacagccaatatggcgcctttttcgtttatcgccgttccggcacaatcgctatctttacttttattggaaagtctttccgaagcaagtaccataagcagcaccgtcctcttccacaatgagttctgtgctggtatggaaacaggagccggcctcgccgtcgtcagactatgacgaggccgctcttctcgacgccactatctacaatgcgaccccatttgaattagacatcaaactcaacaatgaactcgacaatctg

SEQ ID NO: 7275 - DNA, 407 bp, Diabrotica virgifera
  Clone ID: LIB150-050-Q1-E1-D11
aatttagcctctgcaaattagatcataatgagatcagtcacagtacctatttttctactggctttagctgtacaaacaagcttagcaggagtcatttccgacccgaactacaacaaccaacagaactacgatcaggaaaagcaagaaacttttaaccatcaagaacattctgattacggatccaatgatatcggggaccatgaagctcaaataagtcaacaagccacaggaggcgaacacggaggaggtgattatggcggtgaccacggcggatatggcgatcaacaaggctggacaggatactctggcgaagcaagccacgacggtggagctcaacaaagccatgcatctttggaaaaccttggaaaccttggcagccttatatcccatggtattaacttaagggg

SEQ ID NO: 7276 - DNA, 397 bp, Diabrotica virgifera
  Clone ID: LIB150-050-Q1-E1-D2
acccacgcgtccgggcttggcttaaagggcaacatgcttccctgctcgaaaaactaggtatttgccagttcaatgggcagaaaatgggcatttttgtatttataatgtattaggtatatagtatgtagtacccaaaaaaacccatttgaaacctggctacgcaagtgttccgaacatggtatatttttgccttatttccctggtgtatattgagataattcctacatcttgccgagttttgaaatgagagcattatacatattatgtgaaaaaccaagtgacttaatctgaataaagaaatatatttttatgctagtgtattatagagttttatgcaaaagtttggagtaaattcgttatttcagaaagatacgacttctaagaaaatcttaaaact

SEQ ID NO: 7277 - DNA, 292 bp, Diabrotica virgifera
  Clone ID: LIB150-050-Q1-E1-D3
cgcgtcaacacatttgcaaatttggtgaaagagccttcaagtggttatattgtctttatttttttctggttctctcagatattctatgtgttttttttgtttttttccgtcttctaggtttacattatcatttgtaaagatatttttggttattatttaaatttactggaatgagttcgaagatgaaatttcaattgtgatagtctaagagtttatcaaattgttaaagtgttgcttttttgtgaaatattattggtagggatttaaaaaaaacttttttgtgtaaagaaaa

SEQ ID NO: 7278 - DNA, 379 bp, Diabrotica virgifera
  Clone ID: LIB150-050-Q1-E1-D5
agcggacgcgtgggcggacgcgtgggcaaaactaggaaatccaagtccaagtctcctagactaacaacaattgagagggctcgagaagaaagcgaagctattactaagggcttgggacctgaggttgaaggcaggcgcagaacgaggtcagcagctaaaggtgtgacagccactcctccacctccagctaagaaagaaagaaaaagttctagcacaactaaatcatcgagaggcaggccgaagagaactgtagaagaaagtagtgattcacatgatgaaaaatctgaaacctcagtagcagaaagtgaagaacaggcataaagtatcgatgaatccaaaagtgaagctgacactacagaaaccaaatcacatgatgaca

SEQ ID NO: 7279 - DNA, 367 bp, Diabrotica virgifera
  Clone ID: LIB150-050-Q1-E1-D6
atcagcctacttctaggaggttagggaaatcattaatctcagcaaaatgaaaattttgattctcctttcttgcactttcgcgatctctcaagcaggatttgcttcccactagaactattatccccagccccaggcagttataggacacgatggtcggcctgtataaacgtatgacgttcaagcagccaaagctgcccattttgcagctcatgcagcagctaaataccacagtgctccttgggctcaatctggatacgcttctcacaacgctcttcccgcagatacacccgaagtagctgctgccaagttacaacactaccacgactacgctgtcgctgctcatagaaatagcgttcatgggtatgct

SEQ ID NO: 7280 - DNA, 165 bp, Diabrotica virgifera
  Clone ID: LIB150-050-Q1-E1-D7
agttctgttgcaagttgttctagttttgttgttttaaaatctgcgaaaaactatttatagataatggtgaacttaaacaacaaatggacatgcagtttgctgattacgtaattgtgtactcacaacacataagtacaaggattatgccaatacataccaattaaa

SEQ ID NO: 7281 - DNA, 415 bp, Diabrotica virgifera
  Clone ID: LIB150-050-Q1-E1-D9
aatttggttctcaaatttttaacaaatggtactgggtgtgtttttctaatatccccgccaaattgtattttcgcgtcgcttgtaccatggataatcatttcccttctttctccacaattctgttgattcttgagttccgcaatttgtttttcgttttgcttaaatttttcttctatttctcgcctgtcttcttgtattacattttcaaatttgctttctaactgttctatctcgtttttcattgttgtcaaacatccttttatttccttttcatacttttctatgcgttcctctattttcttattgttctcttctattgcttgttttgtttccttttgattgtcatccattttttgctgtgtttccttcattgctagttttgtttcctccggatttctatccaatggtcgttttg

SEQ ID NO: 7282 - DNA, 403 bp, Diabrotica virgifera
  Clone ID: LIB150-050-Q1-E1-E11
aaacaacgccttcaacatgaaacgatcccagcaagttacggtcactgaaaccaccccaggatattcagtggaaaagatgtattataaagaatacaaatatgaaaccgctttctccatttcgcagttatcgaaactggagaatttcgttttacctcctagaactactatcttagcattatctcagaacggaggagacaaggaagaagacaaaaagtatgtcgtcaagaatcacggaaaagctgatctttttgttgaggtaatacatctcaataaccaagatgatgctccacaatggtttgtagtccagccagaccaaaccactgagatagatattgaggacaatcttgaacaaagcgtgttgaaagtaagcaacaacagttacgaacaggaagtatcattttct

SEQ ID NO: 7283 - DNA, 405 bp, Diabrotica virgifera
  Clone ID: LIB150-050-Q1-E1-E12
atttcagttaaaacacatgttaaacaataacaccgtatattttctttgtttctaaatatatcagggataatcaaaaaacaaaatgttcaagaaatatgatactataatacgatttcgatgtatactcacacttgtaccttgtcctccctacagggtgtctcaaacttggcataagagaaacatttcttttcttctacccggtataaggtataattacaaaaaaaagtgagtaaacatttgccaaaatgtgtaaatgtgtataaggaaaatataaaataataaaaaaattagcataatccgttaatctgtctatgaaaaaatcatctgtgaaaatgaacataaatttaagtgatgcataacttttgaaactatgtttatttaattggagatttaacttaagtgtat

SEQ ID NO: 7284 - DNA, 378 bp, Diabrotica virgifera
  Clone ID: LIB150-050-Q1-E1-E2
aggcaagaggcaagacaagccagaaccacaggcacagttcgaagaaactagttgccgcagtgaaccacacagaaccacacatacacacacagtgcttagttaacttttttctgtaaaatcgaccggagtttttgtattagttaataacgaacatgggtacccagaacgttgatgaatcagccacatctcccacagctgaatctccaaaaactgagaaaccagaatccacagaatccacagaagccgctacagttctcaacggataggcatcaaaagatgaaatccccagcgaagcacccaaaacagaagccgctacacccgtagaggaagagcccaaaaaagacgaacctgtggtaaattagcctgcataagaggaag

SEQ ID NO: 7285 - DNA, 401 bp, Diabrotica virgifera
  Clone ID: LIB150-050-Q1-E1-E4
acgcgtgggaagtaatagtataatattcaatgagcatgcaatagccattacatgcgagtggaatactatactttttctacgaccttttttctattattagtagaagaaatattgtattttaaaactcatcgttcgtttattgataaatataactaaactaaagtgattttttactagccgacctattaataagaaaatcactttacttaacattttttgtattgcatagtctaagtgaccatccattgttttaagttacctatataaaaagcatatgttatataataattatcaactactcttcattaaaattaaaatttacagaaacaaataatgtacgccaatagtacgcggctgaatagttggttgcctactattaggaggcgtataatattggcaca

SEQ ID NO: 7286 - DNA, 247 bp, Diabrotica virgifera
  Clone ID: LIB150-050-Q1-E1-E5
agtatccataacgtttcaaatgtagtttgtatgtatacatacaaactacattttttgaaaaaacattaaggtttgaaaatattagtatttattacattaaatacaagaatatgttcgtggaacaaaatatatttttcaattatttgaaagtgtactttttgagaaattttgtacgagtgatagttattaaattcctttttaaataaaggtggcgtagggaagggaaggggaaagaagaaaagacggg

SEQ ID NO: 7287 - DNA, 155 bp, Diabrotica virgifera
  Clone ID: LIB150-050-Q1-E1-E7
aacggacgcgtgggatttactttacaacaataaaatcttttttagtaaacctggagacaaattttacttactgatacctaactactactgtgagacagtatttgatttcgatcacagaaaaatttacttcttgtaccttgtgtatcagggattag

SEQ ID NO: 7288 - DNA, 361 bp, Diabrotica virgifera
  Clone ID: LIB150-050-Q1-E1-E8
gttcttcttagtggcggtgcgggctcgttttttaatattgtgtttgattacggagtggtttctacatattggtatatttttcaaattgggctctgtgccgccattatttattgtattgcgaatacgtgtgccaaatatctcgaaagagtgttcaaggttgcagccgcagtcttggaacgtgttttggctacctgttgatcgctactgtatcaccttaatattacaaaatttggcaattgacacatgttttaaaatttgaaggtttgtgtcaacctctatcgtctatcctttagaatgaaatctatgatatattactgtatataagtaatctaatgtgttgcgtgttcaccctgtatcgtat

SEQ ID NO: 7289 - DNA, 257 bp, Diabrotica virgifera
  Clone ID: LIB150-050-Q1-E1-F1
atgcaaatctagccaaaagctagtgttatagtcacatactcacaccatggcttctcgttttttgattgcttcattccttgtgttaacccttctaggactctgtttagcaggtggtcacggaggaggagaacacaaacgagtcatcatccacgtcccattcaaagtgaagcacattcaccacacccacacagtcgtcaagcacgtcggccatgaaggaggccgcggcggtggcggagaagaatacaaagtcatcggtt

SEQ ID NO: 7290 - DNA, 385 bp, Diabrotica virgifera
  Clone ID: LIB150-050-Q1-E1-F10
tgaacacacgtccgcccacgcgtccgctttaaaatatatacctatgtgtcaatatgaatgagtcagataaaattaaattgttagaagaattttaatcaagcaacaaaaacttaatttattatttgataacgatttctgaaggggaaagcaaaacgtcaaataaattgaatttcaaacgaaaattgtggctaacccaaataaaatgtaaaatacttacaagtttaaatttttataaagatagataacctattagttttctgtagtcagaattatttccaagtactgtttgcaagctattcaggatgccatatacatgtcttccaatggtatatttagggcaatcaattacgaaatggtctctatactgtctactaaatcacaactt

SEQ ID NO: 7291 - DNA, 209 bp, Diabrotica virgifera
  Clone ID: LIB150-050-Q1-E1-F11
aaaaattaaaaaaaaaaaaagggcggcaggtccacaacatcaaacggtggctatgcgtggattcgactgtctatgggatctcgcggtaggacctaaaatcagtacaatcgcaccctattcacaatcccacgacacggtaaagccctgcagtttcccattgtattcttctttatatacatccccctttcggcaatctgtattcataacga

SEQ ID NO: 7292 - DNA, 301 bp, Diabrotica virgifera
  Clone ID: LIB150-050-Q1-E1-F3
cgtactgtcacacttcgcgagggtttaagaaaatgtgattcgtgttaatatttaattgataaaactcgacaaaatgtcacctttgacaggttttttgagtgtagtgtctttgtgcgttgtgatttccgcgctaaaaaccccaaaacaagtgaacattacgaaatgttgcaagttcgaggagtctcttaagaccggagacaacgtttgtgtccaaaactcttccagttcgtggaaattagagatatacaatgctcggaaagccaaattcgagaagcacactgaattacctttgaaattggaa

SEQ ID NO: 7293 - DNA, 142 bp, Diabrotica virgifera
  Clone ID: LIB150-050-Q1-E1-F6
agggtcttcttgttcaatcaccatctcgatcggggaggccaccacacagcatatagtaggagggaccagtttactcgtacaaggaacgtgaggaagcacagtgaccgcagggactgctgtctcatcatcgcggggagggtgt

SEQ ID NO: 7294 - DNA, 399 bp, Diabrotica virgifera
  Clone ID: LIB150-050-Q1-E1-F7
cccacgcgtccgcggtcgcgtgagattataataatataatatttattagtagtagtgaagaattttattaattgatggttgattagtagtgtggtagaataatattttattatttatagaagaatttatttatttgtagcatgtggagcatggaggattaattaataattatatatttattattatcgacgtaattagagcagctaaattaatatttttattattgtataaatattttatataatttttttgttgtgatgtgttgttcgtcgttaaatagaactacttttttattaagtaaattatttttattaattaacaacataataatgattatttattattataatattaatattatgtatttttattggaggatcatcttagtaatattttatt

SEQ ID NO: 7295 - DNA, 98 bp, Diabrotica virgifera
  Clone ID: LIB150-050-Q1-E1-F8
aacccacgcgtccgcggacgcgtgggcgcgagcgcgcccttttttgtgtattttggtttggttatttgtttgtgtgtttttttgtttgtattttttta

SEQ ID NO: 7296 - DNA, 330 bp, Diabrotica virgifera
  Clone ID: LIB150-050-Q1-E1-G2
agttactttacactaatccactattttttagcaaaactaaagagaacttttatctactgatacttaattactattgtgagagaatattttctttttacccaagatgcggttattctttgtaccctgcgtatcagggattatcaagtagtaactatatacttattacttgcgcatttacaggagctacaatattaagctttttactgtcaactaaatagtttacgtaacttttttgtactgcaatgttactcgtttttaaatatatccaatttttgaagcagtaactgaggtttatctagtagcaatatatttatcattaaatacctttac

SEQ ID NO: 7297 - DNA, 395 bp, Diabrotica virgifera
  Clone ID: LIB150-050-Q1-E1-G3
aggtctaggtatcgcgggccgacccacgcgtccacccacacgtctgccacgcgtccgatgagtataaaccagaggaaactgttattgaatttgatgttcctcaaaagactcaatcttcaacggacatcgaaattcccactgaataccatcatggtaagaaaagaattgcacatgcaagttttgaaacattatttggaccttcgaagcctcctgtgattacagccaaacctaaaactgttcaaactccaggtcaaacgttagcaaataggtataaactcgccaaacaagcacaagccaacagggaacaagagttactgataaaccaagttcaacaaactgtagtaactaaaagaccagcgccttctttacttgaagcagctagagaaaaaaagaaa

SEQ ID NO: 7298 - DNA, 337 bp, Diabrotica virgifera
  Clone ID: LIB150-050-Q1-E1-G4
cttccattaaaaaaaccgcaaaaaatggcaaaattggtgattttgttggcatgtgttgctgtatttaatgccgtaagcgcacttgattgctacacttgcaccgacgatgcctgcaaaaaagatgtaaaagaaatgcaaaaagttacctgtggtaaacccgctgaccaaaatcaagaatccgtttgccaaaaagtaacatacaaaggcaaggatggcaaggaacacatcgaaagaaaatgtgcctatgctcccaagaacggagaagctcagtgtcccgcatccataaacaaagctgatgtaactgacctaaaatgcccatcctgtaaagctgatcttt

SEQ ID NO: 7299 - DNA, 410 bp, Diabrotica virgifera
  Clone ID: LIB150-050-Q1-E1-G7
agagaagacagaggtgttaaatagcaataattataagacagaccatgaagcgtgccatcattttagcactcgctatagctacaacactagcagctccatctgacgtccaaggtccacttcaacaattagcaattggaaatcaacaactaacgtcaaatgtatacaaagaaattcttaaaactaagaatggaagtattatcttcagtcctttttctgctgaaaccgtattagcgctgacctctgaaggagcgaaaggtgacactagaagccagctaatatctgcgctacaccttccagaatcacaagagactatccaacaaggatttaaggaacttttaccacaactgaatatcaataatgagtacgcagtattagcttcagctaatacaatatatgtagccagcggtatc

SEQ ID NO: 7300 - DNA, 322 bp, Diabrotica virgifera
  Clone ID: LIB150-050-Q1-E1-G8
cccacgcgtgggaaaatgtgtggtcacgtaaaaccccaaataatattaataatatgcaatttaacatgtaaattaactttaatacacacaggtattctcgctgaagttaatgtttatgttaccgaacatatgtcacaaaagttgtggcagaagtacaggactaatgccaattatagcattcacttcagcatcatcctcatcaccacagttaacggaaactaatgctgttagtgaagatgttagtgatcatgcggagcaccttagggcgctccagagggcacctcaaccggagaaatcaatagtggcagcagcatttgcatca

SEQ ID NO: 7301 - DNA, 377 bp, Diabrotica virgifera
  Clone ID: LIB150-050-Q1-E1-G9
accacgcgtccgcttcagaataaaacttattgtacttttatgtcagttttggtcaattcacaaaatttttatgtgtatttttatttaaattttcagcaaaaaaatggcttgtggcgattgtggctcgtgcggacaatgttgcggttctccatgttctccagcaatgtatccccatgctgtatgttgtatgtcatgtcctccaccaattatccttccgactaagccagaaccagtagaacctttgcaaatgccgtgtgctctaattaaagacgaatgcataccggaagacgtagcattacaaaagcggtaccaaaatttttacaatgcactatatgaagactggcattgtataacaccttcaaatcgtggtccaatgc

SEQ ID NO: 7302 - DNA, 384 bp, Diabrotica virgifera
  Clone ID: LIB150-050-Q1-E1-H11
gaaccttcaaagggaacggttgtgtcaaattacaattttttctgattgtaatttttgctcgattaattaaagtagtgatattttaaattcgcgttcaacgcttcagagctaaaagaaaactaaaaatgacttatccacaaaacggtgatgatggttaccaggctcgttccaatggtttctccaatttcaaaagtggaggaaacagtggaggaggaggaggttacaacaacagaaatggcggtggctataataagaccggaggtggatttaataacggcagatttaataattctttcggggataacagttacaataatcgcaacgggggagggtatcaaaataatttcaacaggaacaatcaaggatatggtggcaacggggggt

SEQ ID NO: 7303 - DNA, 430 bp, Diabrotica virgifera
  Clone ID: LIB150-050-Q1-E1-H2
cccggcccacgcgtcaaggcagaatggcttgcatatgggacatgagaaattccgtggcagcttccttactttattccaacgaattctcagccatcaatagtgtctcctggaaccagtccgatactaactatatagcagtgggaacacaagcaggagacgtatacctattggataaaagagaaccaaaagacttcgtttcagttatttcttgtttttcttctccagtaaataaacttcgttttaataattcaaatcttgcagtttgtggcgattcaaaagatgtgctagtggtcaacactcaatcaaacagtatgaatgtaatttataaaaatgaagagcacaaaggacatgttaaaggactttcctggaacaaggacgttttgtttttctggtggattttaaaagattctcaagttaaccatgttattgt

SEQ ID NO: 7304 - DNA, 349 bp, Diabrotica virgifera
  Clone ID: LIB150-050-Q1-E1-H4
agactatttactagtctaataaagatggcttaaaataagtacaacagaaaatacaatgtttaattctagtatctgtgagaaaaataatgtttttttggtacctgaagatattgaaaactcttgtcgtttgtctcaacaaaaatgctttggtagatatatttaagactaaatatcaagaaactacttttgctgatatttttacaatggttttcatattggagttctcaaagaggctaatattatatgctatgcagatgacacagccattgttgtttgtgagagcacttgggaaaaaactcttaccatagcagaggaaatcatggcaaaaattaaaagttggtttgatgtc

SEQ ID NO: 7305 - DNA, 248 bp, Diabrotica virgifera
  Clone ID: LIB150-050-Q1-E1-H5
agctaaggcttataattgacttctttggtggtactcttagcgcaaattcgggtattcctatgacaatacatcgtaaagcgtgtgccaatttcaactggccaggtatattcgtatcataatctcatacccaataacgtctcaatccaaattgatcatacacatgcaatatcgatgtatcatatggtatatccgcccatgaacatagtcgagtcatatctcgaaaatttctaggagtccaaagtgacttc

SEQ ID NO: 7306 - DNA, 377 bp, Diabrotica virgifera
  Clone ID: LIB150-050-Q1-E1-H6
aacccacgcgtccgaaattgcccaaataacaatgacgtggttcacctacttactcctagttggtgtctgcgccagccaggtgctgtcagctcctaccgaggaaaaaagagatttcgctactgttttgttggaaagagcagctgcacgtgccgaagcaatggccaagagaatcgaagagagcggagtcatcgacaaagcattagctggtgctcaagcagttggcaagaaaattgaagaaactggagttatcgacagagctctagctggagcagatgctcttgccaaaagagttgaacaaactggaatcatggacaaggccaagcaaacagccggacaactttacaagcaagttgaaaacactggaatcatcggaaagc

SEQ ID NO: 7307 - DNA, 411 bp, Diabrotica virgifera
  Clone ID: LIB150-050-Q1-E1-H7
aaataatattaatatacacggattgtacgacatatgacggaagctcgagacaaatgactgtgaatgaaaagccctattgagatctaacgtcatttgtggcctaaatttgagacaaatctccctatcttgtcgatctgtttctggcaagtacgcgacaaccttttgcgaaagtttgtaatactgaaaaacatgtagataggacctttagatttaacagaaaacagtaactctagatggtcatttttatattaaatatctaggtattttattaagttttttctattctagcgcttgttttaaataaaaaaagttcatattttaaagtgattattatatactgatagtaggtagagattattttgttgtatgttctcgtttatgttaaaaaaagtctaattgttggatattttg

SEQ ID NO: 7308 - DNA, 413 bp, Diabrotica virgifera
  Clone ID: LIB150-050-Q1-E1-H9
agcaagcgtccgacaatctcagaaagtgcgagttcattattcattcatttccatcgttgatatatttcacatccacatcacagctgatcggcatgtactcgtgaatccgtgtcgtcaatgatatttgctattgtggaaaaatcaaattcccctagacttgcatgaaaacttgcagaattaaatggtaccaaaccgattatcgcgcaattgcaagaagttgcatgcaataatcaactgacgacatactgcgcatgcctttaggcaacttgcttgcgtcttgcaggtagaattgcaagctgtaaagctgtctttagatatttcggaagtttttagaaacccacatatatttggttttcctcgtttaccacagatcctaagtcagttgccgcgtccgcaagccttgtaaagcactg

SEQ ID NO: 7309 - DNA, 340 bp, Diabrotica virgifera
  Clone ID: LIB3026-001-Q1-E1-A2
aagaagtcttttgacaaacgaaaaattaccgacatttgaaacgatgaaattcgcagttgcatttttggttttggctcttgctgcctgcgcctactcacaggaagagaagccagtattatcaccagaacaagtaattgacctcatcaagcaaaaccaacccgccgtaggttgtagcaatctgcaatgcacactttcatgtataggccatggacacatacctggatattgcgctcctgatggaacctgcacatgtatacctgtcattgcggtcaaaattcgtttaaagttttttaaataccacaattgttttttagctctaggcctatggtaaagactgtct

SEQ ID NO: 7310 - DNA, 373 bp, Diabrotica virgifera
  Clone ID: LIB3026-001-Q1-E1-A4
attgaaaacaacaatatgttcaagttactagttttcatttttgctattacaacagtgatcgcttatgaaactgcttttcaatacccagtgacctgcccaccttttgacccatcggcacctccagtctacgaacctgacccatactactgtgatatattttacgaatgctctggaagtactcccttccaattccactgtgctcctggaacaaacttcgacatcaagacgaatctatgtgaattcaatgttgactgtggagaccgttcaacaactgtaggaacaacgaccgaaggaacacaacccccaaaattttaatcaaataatgataataaagatatgcccaaactataataaaacttgaaccatttttgtt

SEQ ID NO: 7311 - DNA, 423 bp, Diabrotica virgifera
  Clone ID: LIB3026-001-Q1-E1-A5
cggacgcgtgggcggacgcgtgggttttaaaaacagcttcagtagatggttcattagacttatgttcctatagtcttcacaaacttttgctcctggttttttagtcaacggcatgactcagatttgagccacatttttcctgccttgtatatgtcattaaatagttcagctattatttttatttgttctatagctaatagcttcaacagttctgcaggaatttcatcaagtcccagtgcctttccatcctttatttgtctgatggctgccgttacttcttctggtaggatttcaggaccttaattctcttcaatggtgggttcttgtcctattctaagctcgtggaaaagtttcgtttctcaagtattctccccatgctttctttttatcttctttggttatggcaagattgccttcatcatc

SEQ ID NO: 7312 - DNA, 307 bp, Diabrotica virgifera
  Clone ID: LIB3026-001-Q1-E1-A6
cgcgtccgaacgaatctctcgccatctgcagctttcgcgttatctgttacgactgtattcggatttgcacttatgggtctggttctcgctacctgctgcgactcccacgttttgaaccaactgcatcgaccctctcagatccttgcccacaccagtcgtggccaagtctaccgattgttcgggcaatcttccctgccagttctcatgtgcacgtcatcgacacttcgccagcaattgcactccagatggattcatgtgcatgctgtgctgtcattgcagtctatgcttcgtttatagaccgtttgga

SEQ ID NO: 7313 - DNA, 350 bp, Diabrotica virgifera
  Clone ID: LIB3026-001-Q1-E1-B4
attaaggatgagcttaaaaatacaattttattaaaattaatttttaaataagaattacggttaaaaagtttcaaaatttgaaataaggtaataattagttttaaaaaaccataattttagtttttacaaattttttatgaaaatatgaaattaaattagttaaatttagtaatgctgataatattagtaatacaaaattgtatacttagtaaaaatacatacgtgtaatagaggggttccgcaccatttctttcacccgtttagtaaaaacaggtcttcttgggaacaaaataaaagctcgccctggcacagaataaatttggagggcccgggaaattgggcgcgcgcaa

SEQ ID NO: 7314 - DNA, 394 bp, Diabrotica virgifera
  Clone ID: LIB3026-001-Q1-E1-B6
aaactcataaaaatatacggagtttaatttgttttaaaccccattgttttgaacaattaatttcagatgcaaatatttttgcatatatattttgaatttttcaatatattgtcgatctagtatcacttcgatattatgcttataaaattttttgtagacgaaatttatgaacatcctaaaaatacttccagaggagatagtacagtatagctccaagaaaaactgacttactggaaaagttctagttacttgtagaaatattcccgaaaagacattctactgctctacaggattgtcaatactgttaagttatatatatttgaataggtataataaaattgttctgtataaagaaatatgtgcagctgcacatttcagttttggataaacaaat

SEQ ID NO: 7315 - DNA, 335 bp, Diabrotica virgifera
  Clone ID: LIB3026-001-Q1-E1-B7
atttatttattttaaaataataaaatattttttagtaaaagtaaagaaaaattttatttaatgatagttaattagtattgtgagagaatattttatttttacaaaagaaaaatttactttttgtaccttgtgtatcagggattattaattaataattatatatttattattttcgaatttaatagagctaaaaaattaaaattttatttgtaaaataaatatttaaattaatttttttgtactgaaaggttatccttttttaattataccaaattttttagacctaattaaaattaattaataaccattatattaataattaattattttaaaat

SEQ ID NO: 7316 - DNA, 390 bp, Diabrotica virgifera
  Clone ID: LIB3026-001-Q1-E1-C2
aggacacgtgggcggacgcgtgggcggacgcgtggggaaacctatcaaatttttaaaatgtacactaagtttactgttgttgcccttttattgtgtgttgctttaaatgaagtacatagcggagttatactcggcaaaggattacgtagaagttttacagcatgtcctgatcgccttaacccatgaatattggtatccgacaacgacatttcaggaggtctcttcgaatctatcaacttaagagttccagaaataagattgttataaacgcctatttcatgcatattgatcgttgataaaaagaagagttcaactgacccaattattggtgcacgaggtgtatgttctccatatgttgaaataagtatcaaaccacgattcttcgaatct

SEQ ID NO: 7317 - DNA, 287 bp, Diabrotica virgifera
  Clone ID: LIB3026-001-Q1-E1-C4
caccacacgtccgcaacaacagaaccaccaacacgagctaattaaacgtcatcattttaatattataggtacgataatattttattgttcataatttcgtattaagaagatagtcggttcactgaacacggacacggatggctggtgaatttagtatgccaatttttgttttttgccatttctgccaatattggttattaagtttggcaaaattactatctacgtatttagtgataatatattaatgccaaatttgccaatctggtatacttacttactggagtcac

SEQ ID NO: 7318 - DNA, 411 bp, Diabrotica virgifera
  Clone ID: LIB3026-001-Q1-E1-C5
aaacagatgatttccaaggattatctggagttaaaaatccactcttaagagctattaatgaacaattggcaacatcttcaaacgctgctgctgaaacaaatgaaattgcagctgcagctgcggaatcctcagcttccgctgcagaatcttcggcttcagctgcagaatcatcagcttccgctgcagagtcgtcagcttcggctgcagaatcctcagcttctaacacaaacagtgaggctgcttcaaatacctcaaacaatgaagccgcgtcaaattcaaaagttcagaacagtgtgtgctctaaggctggatatgttagggatcccagcgattgctccaaattctactattgcgctgctaataccagtggtgttttagttggtgttcaaatgtcatgttacggtggtcttt

SEQ ID NO: 7319 - DNA, 333 bp, Diabrotica virgifera
  Clone ID: LIB3026-001-Q1-E1-D12
atcatactggtttgaacaaactgacaccagcttcgatgggcttcgaaaattcttggaaaacacagttgcacgtgaagcaaaagataccttcttcgtctcacaaaaacaggtcctagattttataaaaaatcccgttaaaattagcgattttaaaactgctgacgcgcccgatggagccagttgtgagccttacacctgcagacttaaaaaaggaacagaggatagaaacatggacgcgtgtgttccttgtccagacgaatacccatggattaataacgttaatgtataaataatcgtattttgaatctaaataaataaaagtttgatagattt

SEQ ID NO: 7320 - DNA, 102 bp, Diabrotica virgifera
  Clone ID: LIB3026-001-Q1-E1-D6
atttggagtacagttccatccgttgcagccttgggtgttttcttcaggtgcggatagcactattaaattatattctaattaaattataatatttttttacgt

SEQ ID NO: 7321 - DNA, 199 bp, Diabrotica virgifera
  Clone ID: LIB3026-001-Q1-E1-D7
tggagtacagttccatccgttgcagccttgggtgttttcttcaggtgcggatagcagtattaaattatattctaattaacttataaaatttttttacgtacaatgtgtaaatgtgaaaaaaaaaaaagaataaaataaagatgaagaaataaaaaaaattacttggaaaaataaaaagaaaatgaagatgggggcaacc

SEQ ID NO: 7322 - DNA, 206 bp, Diabrotica virgifera
  Clone ID: LIB3026-001-Q1-E1-D9
accacacgtccgcggacgcgtggggaagaatctacgactcggaaataggtggtacatttggacatataccggtctccactgagttatacgaggacgaggatatggcatactatgcttttggcgatgatgtccgcgaatctaatgtatacgatattttactgtattatttcaaataatagataacgtaaaatatagttgttaacaat

SEQ ID NO: 7323 - DNA, 417 bp, Diabrotica virgifera
  Clone ID: LIB3026-001-Q1-E1-E12
aagcattgaaaaaataccagaaactttgtatcaaggaagaaacctagaaaagctgtacctaaataacactggatttgtcaacttaacagagaaaaacggatttccacctctgccatctcttcaagtactccatctgtgtagaaacgagcatctacaccgtattgcaagattcgcttttgcaggtttaacaaatttgacagatctgagactatgcgataatattgatttaactaccatagatgattttgctttcgccaaatcgactaatgttagcggcggggttatctggccacctcttaaaaagctttatattggaaacaacaaattgtcttacgtagacagcgacatcgtagcccgttgggactctttgaccgaattagacattagagataatccatggacttgtgactgtgaaaa

SEQ ID NO: 7324 - DNA, 326 bp, Diabrotica virgifera
  Clone ID: LIB3026-001-Q1-E1-E3
cgggtcggccacgcgtccgcacacacttccgcccacgcagtccggtaatgctccagaaaatggatggggtgaccgatatagtggtattcattcagtacagtaatacaatcatttaccatgacaactacaggcatgatgttaagttacatgcgaatccaggcatagaatttcgaatctatacatatcttactatcaagttaaatgtccactcaaagttggtgtctatcacaggctgtggagatctttaaattattttttggtaatgaaatgttattgcgtggaattaatatctaattttatatgctataaattaaatttatttatta

SEQ ID NO: 7325 - DNA, 424 bp, Diabrotica virgifera
  Clone ID: LIB3026-001-Q1-E1-E4
attatttcattaatctccaaaattaatattttatataaactaatatctgatattctaactttaattattataataattatatgttcaattatatttatattattaaatcaccctttaacttgtggtttaatattattaatacaaacaattttcacatcagttattacaggattaataaattataattactgattttcttatattttatttttaattatagtaggaggaatattaattctttttatttatataaccagaattgcttcaaatgaaaaatttaaatttaattttaatataactttaataataattagaatttttattattatttctatattaagatttattttagattatttttattttaattcttttataaaaattatagaaatgaataaccaatttaatattattaataataaat

SEQ ID NO: 7326 - DNA, 80 bp, Diabrotica virgifera
  Clone ID: LIB3026-001-Q1-E1-F1
caccacgcgtccgcccacgcgtccgcgtttttcttttaatataaaagctagactctattgagcctaggaagtatttgaat

SEQ ID NO: 7327 - DNA, 418 bp, Diabrotica virgifera
  Clone ID: LIB3026-001-Q1-E1-F11
attgcattggaaatggatttctggagaagatcagctagaaaattaaggcttgaaagaatacaaaatgaccaagtcagaaatataattaagtcaaccatcatagataaaattcaaaggagacaactgatctggtatggtcatgtagaaaggcttcacttattttccccgagttatgcatctagtttattgttactacctctatgtgaataactaaacatgtagttaaaataacacccatgatttataaattcctgaaataaatgttatttatattcattatatattgttacataattatattctctaacaagttcaagtcgattttaatggaacatatcatgaaaaagaaggaaatcaaaattatcatcgtgtcattatatatgctcaaagtagaagtataattgccaacaaaatattt

SEQ ID NO: 7328 - DNA, 300 bp, Diabrotica virgifera
  Clone ID: LIB3026-001-Q1-E1-G1
cgttattattaaaagaatcatctagctttttgaagctagacctcttttaatagaaccaaaatgcgagcgaagtggcgtaagaagcgtatgcgaaggctaaagcgtaagcgcaggaagatgcgtgcaagatctaagtaaatcattggaacttcatctctactagtattttctttgaagatttagaagatgtgaagttgcattctattgaaaaaacggaaaattggatcatcaatcgcatttttttttataaattgacctgttggtgtgaaaaaaccaaaaaaatatataaaatattaatat

SEQ ID NO: 7329 - DNA, 421 bp, Diabrotica virgifera
  Clone ID: LIB3026-001-Q1-E1-G11
aattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaa

SEQ ID NO: 7330 - DNA, 400 bp, Diabrotica virgifera
  Clone ID: LIB3026-001-Q1-E1-G12
accacgcgtccgcccacgcgtccgattttgagatgggtactccaaatgagaacgaaaacgatagattccaatattataacaccttcaagttgttatattgataaaaaaaatgcttgaatagctggacaatcataaaatgatcattcattatggatattgtatatataaagctacttaaaccataatactcaattaaatccacgtctgtatataatttattctttaaaagatctaattataagaaatccaatatcttactaccaaatttttgaattatctctaaactaaccttccccgctaaagtaaacgtattgtaccctattattgacacaataaaattgtagcaataatatccattctaaattacttttatttatgcatttaaatgtttgtaaaacaa

SEQ ID NO: 7331 - DNA, 424 bp, Diabrotica virgifera
  Clone ID: LIB3026-001-Q1-E1-G2
acaaaatgcatatttttggagatatttgcaaaaaaactgttgaaaatcgtgagaaaatttcgaattttcaattgccaataccttgaacagtattgggtttttgaaaaaactttatgcaacattttttgcttaaaattaggtcttctatcgatatctgagattattttgaaaaaaaaaatttccaccaccgaaaaggggtggcaaccacccccagggtgaaaacggagttcgggtcaatatcacttttgaagttaagggtgggataagcctagttccaggatttcatgtaaatcggttcatagtaaaaaatttctgagctaaaaagcttcaatgactgcactaccaataattttaagtttttgaataaacaataggactactatttgggaatctggcctaataattatttaaataataacggttt

SEQ ID NO: 7332 - DNA, 295 bp, Diabrotica virgifera
  Clone ID: LIB3026-001-Q1-E1-G4
cgggaatgaaaggttggatgaaaaaaaaactgtcttagaataatttaagaagaattttatttttggagtgaaaagcataaaggtttttaaaagtttagtattaccaaatgagttttaaaatattggtaccagggttttagggaataaaaattaattattaaataaattttattaacgggggtgaaagagctaaaaaattaaactttttatatggaaatatataggttaagaaatttttgtgccaagatatgtgattcgcttttaaatatacctaagggattaagacgtaaattaa

SEQ ID NO: 7333 - DNA, 383 bp, Diabrotica virgifera
  Clone ID: LIB3026-001-Q1-E1-G5
accacgcgtccgcccacgcgtccgatccgaaggatcacccaaaaaagacaaaaagaagaagaaaggtttaagaactccttcgttccttaagaagaagaaagaaaaaaagatccgtgaagcatatgaactgcctctgccagaataatacaaacgcctccatcgagactgccagcaattaattcattttagtttagtaaaaaaaaactggtgcggctaaaatttttgcactatatctgtgacattggactgcatttgtcaaattcgataaaaaaatactacaataaattatattttagctttatctgtacaggaaaaccataaagatttttaatattaactttcaaagtgcgacatagtagtggattaatatattatattccaaa

SEQ ID NO: 7334 - DNA, 355 bp, Diabrotica virgifera
  Clone ID: LIB3026-001-Q1-E1-G6
accacgcgtccggagtcaactacgaaaggttcagctgcaagtttatttacaggcacgaaatattttatggctacatttgtaatcgtggttttaaattacttcttaatgtaagttaaatcaaaataaatatttttgtatttatgcacgattgtaaatgaatatagttgtaaagtcatttcgaattaaattataatttttgtaaaattaattttgtaaataaaattttatttttaacaaaaaaaaaaaaaaaaaaaaaaaaaaaaaaaaaaaaaaaaaaaaaaaaaaaaaaaaagaaaaataaatgagtaaaataaaaaaaaaaaattaaaattgaaaacaaaaaaagggggggccc

SEQ ID NO: 7335 - DNA, 407 bp, Diabrotica virgifera
  Clone ID: LIB3026-001-Q1-E1-G9
actccctacaatattggatgtgagacggcatttggaaaatgggttaaagctcatgctgtagacatcggagcagtgtgtttcacattagcagtgttacaactcatcggaattggattctcctgtcatttgtccaaacaactgaagaattcatattatagtacataaagtagttatcaaatcactaattatgttattttctaagaattattgttatttttgtaattttttttccgtatttttatttttaagtatagatattttatttcaatatttcaagaggaacgaataaaacagattattttgatgtaccgaatgtaagatttttgattttgtacttaaattttttggtaaagaaaaatcataattttggtattaaaaattgaagcacaattaaatttttcacaata

SEQ ID NO: 7336 - DNA, 299 bp, Diabrotica virgifera
  unsure (1)..(299): unsure at all n locations
  Clone ID: LIB3026-001-Q1-E1-H11
agtttttattaaaagaatcatctagctttttgaagctagaactcttttaataaaacaanatgcgagcgaagtggcgtaagaagcgtatgcgaaggctaaagcgtaagcgcaggaagatgcgtgcaagatctaagtaaatcattggaacttcatctctactagtattttctttgaagatttagaagatgtgaagttgcattctattgaaaaaacggaaaattggatcatcaatcgcatttttttttataaattgacctgttggtgtgaaaaaaccaaaaaaatatataaaatattaatat

SEQ ID NO: 7337 - DNA, 379 bp, Diabrotica virgifera
  unsure (1)..(379): unsure at all n locations
  Clone ID: LIB3026-001-Q1-E1-H12
aatatgtacagtctgggtctcacagagtcacctaactgtgagtgtggaaaagnaagtaatctactacatattctcctcgaatgttcacatcaatcagtaaatataaacaaattttatgataatcttaatatattaaaaattccacttcccgtctacctgaacaatttgattttttctgaagagattaatatattaaaaacaatttacgaacatatcaaaaattgtaaatatagattgtagcaataaaatttaccctgtatttaagaaattttgttaaaacaaagcaagcatgtttgttaaaacaaaacaaacatgtttgttttgttgttattttgttttaaatcctgtagatttaagtaattattgtatattataattg

SEQ ID NO: 7338 - DNA, 420 bp, Diabrotica virgifera
  Clone ID: LIB3026-001-Q1-E1-H2
ggggcagtacgtgacgataaaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttgggacagactatgaaagttattctgtaggtttgtcctgttttgaacgaaatggtgctcctctagcgagccttttcatttcaacaagaactccatttccaccaaaagatctggtggattcgattctccaagttcttgacgacaacaattttgctaaaaagccactaatcttcacagaccaaaatgaatgtacttattagattaaaatattatacgagtatattacctgacataaaaataaaattttataaaaa

SEQ ID NO: 7339 - DNA, 427 bp, Diabrotica virgifera
  Clone ID: LIB3026-001-Q1-E1-H6
acaattctgaagaatctttggctttcctaggactaattggagaacaaaatatcgaagaaagggccaaattactagatgaaaatccagcaaatgtagcagaagccctcaatgtagctgaagaagacaaagaaaacgttggtaaacaattaaaagcattatatacttcttcttcttttacggatgatagagatgcattgataacgtttacaagtgacgcagtttttgtacgatcaataatacgtcaagccgaaagcatatctaggcacgtacctgtgtatctgtatgacctaacatatttgccagaggatagtactgctcaaggagtcgcgcatggagtagacatgcggtatttgtttggtggagattctcatggcctagtatttaatgaaaatctccgaaaatctttattaaagttttggactaaatt

SEQ ID NO: 7340 - DNA, 349 bp, Diabrotica virgifera
  Clone ID: LIB3026-001-Q1-E1-H8
attggttacactttcaccatccaatgcacataattattacaactgtccacataccagccaggtccgacaccaaatttaccagaatacattacaggggaaagttatccatgtacgcattccataaacgggtttctttcacgcaccactcacttgtcttcagggacccgtcattgatgatagttgtactacaccacttatagatgaatgtggttatagagcggactcagtagttttacgaattgacccacttcaatcaagttaacaactgcactacgatgttcagatctatgtggcaccatagacacgttatctataaataaactttttggactgttgtagaatttgattc

SEQ ID NO: 7341 - DNA, 373 bp, Diabrotica virgifera
  unsure (1)..(373): unsure at all n locations
  Clone ID: LIB3026-002-Q1-E1-A1
agattgcttttgcagtaactttttgtttgctggtaatatctgcacagggacanattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagtta

SEQ ID NO: 7342 - DNA, 193 bp, Diabrotica virgifera
  Clone ID: LIB3026-002-Q1-E1-A10
atgtaaagcttgaggaagggtagcacattagatttgatttctaccagaatgctaacaatccaagaatgcacttcgaccaagtccaatgtcctgctgaaatcgttgccagatctggttgcagtctttaaataataatataatataattattggttttaaaacaattatgttttacttaagtatatactcaattt

SEQ ID NO: 7343 - DNA, 370 bp, Diabrotica virgifera
  Clone ID: LIB3026-002-Q1-E1-B1
gtgaaacattgtattaaaattaaagtgaagtaaaataaagtagaacaatagcattgtgaatcgttgagaaacagttgaaattcgaacaagtgatctatcattttcattatggcgacagaatacgtgcgtttcagcccaaacgcatttctaaattcgtttaatgcaaaactagaacaaccagtccgacaacatctcaaaaatgtatacgcctgtttggccatgtccacaatgtctgctgcccttggcgcagcagtccatctcttcaccaacatcatgcaagcaggatttctatcagcaataggagctttggtattcttcttcctcttagtaaacacacccgatgacaatggcaaatcaatgacgacaagag

SEQ ID NO: 7344 - DNA, 415 bp, Diabrotica virgifera
  Clone ID: LIB3026-002-Q1-E1-B11
tgtcgaacaaattaattaaacatgaaacatcacgacgtcttgaaatttacactggttttaattgcagatcagggatcgagcttattgcattgaaagcgcatatgttccgaaaaaagattttcatacctgtatagtcgatatgattcaattttacatattttattaatattaattttcaattgattataacaattagttgatcgtaactgaaatttttgataaattttgcatgagtatggcgccataaggcagaatatggaactatttaacagtctcaattgtttatagtgtgtcaaaataacattatcgctttgacagccatactgacgcttagtgtgtatagaatagtgagattgttaaataggatttctgcgattaacagcaagtgcaacatttgtgacataaccatcatcac

SEQ ID NO: 7345 - DNA, 391 bp, Diabrotica virgifera
  Clone ID: LIB3026-002-Q1-E1-B3
aattgactcattttttatacaatgaagaaaacaacaggaaccagccagtaacttatcagtatttgttgaacaagaaaggatctccaccgcggaaccttgaatcgatagttagaaagttgttgtattgtataatgtagaatatcagtatcttgtttagagttcaaagtgtgttgttacaaatcataaaagatgaagcaatgaaaactgttaattgtatgaatgatgattatgaagttagtatattatatccaaaaccagtttcatctcagttttaatttgacttattaatcgttttatgcctttgtgtttagtctttactcatgaacacataagtattgtagccatttttcgaacaatccgtctactttcccattagttaaaagttcctaat

SEQ ID NO: 7346 - DNA, 412 bp, Diabrotica virgifera
  Clone ID: LIB3026-002-Q1-E1-B4
aatcataacagatgaagcactgaaaactgttaattgtatgaatgatgattatgaagttagtatattatatccaaaaccagtttcatctcagttttaatttgacttattaatcgttttatgcctttgtgtttagtctttactcatgaacacataagtattgtagccatttttcgaacaatccgtctactttcccattagttaaaagttcctagtcttactacgtttattagattacagataatagtaatacatcactttagaaacatgcaccacatttctttaacaaccatacatgtctgtcatctgatagtcctttaacatatttttgaactcaaccatattggtgaagatctacactgctcattgccttataggtagatataatgatattttggaagttaactgggttaat

SEQ ID NO: 7347 - DNA, 406 bp, Diabrotica virgifera
  Clone ID: LIB3026-002-Q1-E1-B5
acggacgcgtgggtgaaagaagacaacaaatagaagctcgcagactcgagagagagaagaaaaaactggaagtcgaaaaagagcgaattgcgcgtgaaaaagtagcattggcaaggattgaacgggaagcacattgggagaagcaaaaaaaaatggagtatgacatgacaaatatgtacgaaaaggatatggacagaagagttagtaaaaggtctgcaccttttcgtcgggaagaatttgaaaggaagagaccagcatatgatagacatttcaatgagccgcctccacctccaagtctaaaaaccagggaagccagtccacaaagcttcagtagtcgttcaaaggaactttacacgaaaagtgtaaaatactctgtgccaaagcgagattcactttaacctgaaaa

SEQ ID NO: 7348 - DNA, 288 bp, Diabrotica virgifera
  Clone ID: LIB3026-002-Q1-E1-C3
tagttttataggttagtatttttattttgttattaaattttttattataggcgtgctttgtgattatttatgtttagtagatgatgaagattttattatgagtggcattgtgtatttagtaaaaatatataggtttattatctgaattcggcaccatttttttcatctgtttagtaatagcatgtctttttgtattatgtatgaagtctcgcctgccgactgattaatttgaatgggcgctgtattttgagtgtggtaaggtatcataatcattactttttttattga

SEQ ID NO: 7349 - DNA, 393 bp, Diabrotica virgifera
  Clone ID: LIB3026-002-Q1-E1-C4
acccacgcgtccgcgaaacgaaaatgtcacatacacataacctaacatttgattaaaagaaaagaacattaaaaagtatttgtattgaattttgttgattgttgtaaatagaaccaagtacaggacatagcctttaattcaaaatggcaatgttggtgcctgccataaataaaagttttatgttattaagtcaatgtgtaccatgccttaaacaaggagcatccaaatttaaagtgaagcgcttagagcttgataccaatttaaatatgtttttcccaaaacatgagttcgtgtatgcacacgatcctgaaaagaaatgtaagtctggtgatatagtcatagttgaacttctgccagaaagacttactagattgattacgcacagagtgaaag

SEQ ID NO: 7350 - DNA, 381 bp, Diabrotica virgifera
  Clone ID: LIB3026-002-Q1-E1-C5
acccacgcgtccggaggatagaaaaggctgctatatttgtgtttactgtgcagaacatcaatttagtatttgtaaagattgtaaataatataaaaataaactattcaacttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggagccccccaaaaatttaaaaattataaaaccttcaaagtgaaataaaacctaattaaaaatttcaccaaaattaaaattaatggagccttttt

SEQ ID NO: 7351 - DNA, 394 bp, Diabrotica virgifera
  Clone ID: LIB3026-002-Q1-E1-D10
cccacgcgtccgtgtaaatacaatatttcacacaagatgaaatcagtattcgttactgtattcttcgcttgttttggcattatgttatcagcacaacttccaactccagcatcaagtccaacaccaaaaccagatgacgtagtctgtggagtttgttttacgaatgggaatagcatggaagctttcaagagggaagatattcctaaggaaacagcatcatcgcaaaagacttttgcatgtgaagtagtgtttgcaactgagtacacaaggcaactatgcttggactcatatcaagaggaggttgattccttttatgacgaagttggcactgacacagtaatggacatatgcatcgaattgaaaaagtgtccagctaatggaagttaataacgct

SEQ ID NO: 7352 - DNA, 307 bp, Diabrotica virgifera
  Clone ID: LIB3026-002-Q1-E1-D2
cgcgtccaattattatttatttaaaaatcatataatattttttagtaacagtttcgactaattttattaattgatctattttaagtattgtgagagaccattttatttttatccaagaaaaatttattttttgtaccttgtgtatcaaggattagtttataataatcatacctttataaatttccattttaatagaggctaaactttttaatttttattgtagtctatataatttacctaactttattgtaatgaacagttactcgtttttatatatatcaaattttttaagaattacattaaattt

SEQ ID NO: 7353 - DNA, 102 bp, Diabrotica virgifera
  Clone ID: LIB3026-002-Q1-E1-E1
ggaagctcccagtatctgttcattaagcactgtgagtctggtggatacacacagcattatcgctaaacttgccaacgccctatcaccagcacctttcgcatt

SEQ ID NO: 7354 - DNA, 89 bp, Diabrotica virgifera
  unsure (1)..(89): unsure at all n locations
  Clone ID: LIB3026-002-Q1-E1-E4
acctacacgtccgctnttagataatatatatgttaggcaattaaaagggcacttttaaataacgggtggttgaatattaagggtgaaat

SEQ ID NO: 7355 - DNA, 103 bp, Diabrotica virgifera
  Clone ID: LIB3026-002-Q1-E1-F1
atggaggaaaaaataattccaaaaaaaagaatgtgtgtgtactttgtacgcacgtaagaagttatacttctactacatattatgtgatttttaagacaatacc

SEQ ID NO: 7356 - DNA, 180 bp, Diabrotica virgifera
  Clone ID: LIB3026-002-Q1-E1-F10
cccacgaatccgaccacgcgcccgttactttacttgtgacctggatagcacccaatttattatatcaacatcgtgtagttatctactgttacaatagctatacagatatagtaaatatgtacgacaaaggttggtgctgcaccacatcccgctcagtgaagggaaacgtcaagacaccta

SEQ ID NO: 7357 - DNA, 348 bp, Diabrotica virgifera
  Clone ID: LIB3026-002-Q1-E1-F11
cccacgcgtccgcccacgcgtccgcgttctagaaggagaaacgcaaggttcaacaactggggaaggcaaatttatagtacatttcttaaatccagacgtaactgtacctttctgggttcttggtacagactatgaaagttattctgtaggtttgtcctgttttgaacgagatggtgctcctctagcgagccttttcatttcaacaagaactccatttccaccaaaagatctggtggattcgattctccaagttcttgacgacaacaattttgctataaagccactaatcttcacagaccaaaatgaatgtacttattagattaaaataaaatacgagtatattatctg

SEQ ID NO: 7358 - DNA, 347 bp, Diabrotica virgifera
  Clone ID: LIB3026-002-Q1-E1-F2
atccaagcgtccggctgtccaagaagttgattgtgtgagataatgctgtctctgcggagtcaaatatcacggccactagagatcatgcagggctttcagtaataccggatccctcgaaggtcaactcgccatccacaaaaatcaacgtgttcctctcagtggacagccactcggtagactgtaatcatgtatacgcttgttgtcaacgtcgtttgtctacaaaagccttcctttaaacagttcatcatgggccttcatcaaaagtccaatatgcctaaacacgggtataaggccacttcaaccccgtgcaacacaaccccgtttcgtcaattagtggataagtcaaa

SEQ ID NO: 7359 - DNA, 399 bp, Diabrotica virgifera
  Clone ID: LIB3026-002-Q1-E1-F5
cccacgcgtccggtcgagtcggaggccagcagggtcaggggggtattcaagtgccccagcaagtgcagatggccgtaggaagagcagtcaccaatgccgctatcaacgaactatccaacgccttcaaattccataagtaaatctttatttatttattttttgtttgagtttatacattctctttcgttcttcttagcgcgtctagtagaaaaccaggttttatataatataatatttaaagctgataaatgagatattttgtagtttagactgaatatgggctttctattggacctaaggagatcttactaacactaacctttcaatgccagtatactaactgttctttttgttgttaagattgttattattactattaaagaagcaatgttaacacag

SEQ ID NO: 7360 - DNA, 269 bp, Diabrotica virgifera
  Clone ID: LIB3026-002-Q1-E1-F9
accacgcgtccgttaatttatttattaactggataccacccaatttaatatataaacaaaatataattatctagtgatacaataaatataaagatatagtaaatatgtatgacaaaaattggcgatgcaacaaaaaaaaaaaaaaaaaaaaaaaaaaaaaaaaaaaaaaaaaaaaaaaaaaaaaaaaaagaaaaaaaaaaaaaaaaaagggcggctgccctaaagggttaaggctcaacaggacccacccttaagttcacggctcttca

SEQ ID NO: 7361 - DNA, 419 bp, Diabrotica virgifera
  Clone ID: LIB3026-002-Q1-E1-G4
acatgattaaaccaaaatggactggaagaatcagcgcacaaaaagtccccactgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcaccctcaacagctgcaccatacactttatgcacacaagcccttttt

SEQ ID NO: 7362 - DNA, 332 bp, Diabrotica virgifera
  Clone ID: LIB3026-002-Q1-E1-H1
acccacgcgtccgagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataat

SEQ ID NO: 7363 - DNA, 158 bp, Diabrotica virgifera
  Clone ID: LIB3026-002-Q1-E1-H11
aaaaaaaaaaaaaaaaaaaaaaagaaaaaaaaataaaaaaaaaaaaaaaaagaaaaaataaaaagaaaaaaagagaaaaaaaattaaataaaaatgaaagaaaaaataagagaacatcaaagaatgtaaaataaattcaaataaaatgaggggggggg

SEQ ID NO: 7364 - DNA, 389 bp, Diabrotica virgifera
  Clone ID: LIB3026-002-Q1-E1-H2
cgacgaagatttcgaggctgttctttgactacacaacatactggcccagtttaaaaatcgtaggcaactacgaagcaaccgttaaagagcttttccttacacagcactacaaaggaacctacaacataaccatgattaaaccaaaatggactggaagaatcagcgcacaaaaagtccccactgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttccttaaaatgagattcaacactgtctggtatccc

SEQ ID NO: 7365 - DNA, 307 bp, Diabrotica virgifera
  Clone ID: LIB3026-002-Q1-E1-H3
ctactgttaaaatgggtaacacccaaaagaagagttacaacctagaggcttcgcccaattcgaaatacagcctgccgcagagtcaacagattccaccagtaaaggaggaaacacccattgaggtgaccggagaggtgcaggacgaaaagctaaggtcagtagtagacggccctgttcggactaatgcagttgttgatggagctgataagggaacatagctattattaggttttatatttgaatgtaaatttgtactcactatgccagtattatggttacagacactgtaaatagaagtatcgaatat

SEQ ID NO: 7366 - DNA, 290 bp, Diabrotica virgifera
  Clone ID: LIB3026-003-Q1-E1-A3
gcttatcttcctgtaaatatagttgaaggcttcaactatgcaaacgtaactttaaatgataaaaactatatggctgacaatcttcagattctatgtttcaaaaaccctgatgcattgggatggcaatatacaaaagcagcaaactttgatgacttattgaatgattctaaaattgctcccatagtggctggttggggggcacattcacggcggaggcaggggggacggtatatatgggagtgcggttcgtgcgagctttgggaggcaacaatgtaggaaaagtatatcac

SEQ ID NO: 7367 - DNA, 397 bp, Diabrotica virgifera
  Clone ID: LIB3026-003-Q1-E1-A5
caaaaaaatacattagttaatattattgttactctgctttaaaataactttttaaacaccaagaatattacaatgcttcaaaacttttaccacttcaaatacacgtcaaactttaccacttcaaataccatgtcaaatacagctgatctattaaatgtcaactttccatgttagtgggcagtttctatacattttctgagaggcgagggggactagacataaaaagaaaagtgcggcaggtgaaggatccgggactgtaatagctcaatgttcctatgtgtctagtagggcggctgttactgtatacagatacatttataaatactgtaataacagatatatttttacattgtgtacatagattgttgtaaatatattttattatattatctggttt

SEQ ID NO: 7368 - DNA, 380 bp, Diabrotica virgifera
  unsure (1)..(380): unsure at all n locations
  Clone ID: LIB3026-003-Q1-E1-A6
agaagtcagacctgaaccaacacaagaaattgaagaacgcccacgatttcttcagattgaacaaattgggcaaccagtcaatggacaaagattaccaattccagaagaagttttgactcaactgaacagattacccaaccgtgatgttatcgtagctgtatcagaaactgattctggggatgctcgcgaagaggttcatggcgtgcaggaggcggnagacaaagtgccaaggaaagtgatgggtagacaaacttatactagagctcttcccattaaccttcctgtacacgtagctcctcaagatcaagaatctcaggaacaggagcaacaacaagacgaactcagacctcattttgttcaacccagatcagtctgaagtc

SEQ ID NO: 7369 - DNA, 168 bp, Diabrotica virgifera
  Clone ID: LIB3026-003-Q1-E1-A7
tggactccaagatcagtgtacatgtatatgacgccaattaccggaacacccgcttagcgcatcatggtcttttacgttcaagttgtagtccatggactactagaggctgaaccacgtgatctacagatcaagacagcaatgttcaggaaaacttcaggtgggattcct

SEQ ID NO: 7370 - DNA, 380 bp, Diabrotica virgifera
  unsure (1)..(380): unsure at all n locations
  Clone ID: LIB3026-003-Q1-E1-A8
gaaagactcggttaaaatcccaattgccacactaaaagccggaggcccaaataaccaagtattgttagatctgtcattcccagacccaccagtcacattttcacttatacaaggtaatggaccagttcacattgtaggccatcatttaattggtagtccgatggaagaattcgatcggatggagcgcgtanaacangaggggtgggcggggggacaangggaagaatganccgggacgatgggaaaacggaaatcgaatggaaaagtaaaggtgtgacttgagccccaatccctctagaaccaatatttttttatatttcaggaggaagatgaggatgaagatgagcccaaagccaaaagagcagaatcagcgactaacg

SEQ ID NO: 7371 - DNA, 182 bp, Diabrotica virgifera
  Clone ID: LIB3026-003-Q1-E1-B3
gtttaagaggaaccgcaactcatttccttgaatgccaaagatctgagactgttggagaaattaaggatcgtattgcaactttgggatcgcttaaagcatccgaaatcagtctttatgctgctggagttccagtttctgacgaaaggttggtagccgattttgagaacacagacattgaattg

SEQ ID NO: 7372 - DNA, 372 bp, Diabrotica virgifera
  unsure (1)..(372): unsure at all n locations
  Clone ID: LIB3026-003-Q1-E1-B6
acataatcttcatcctacttcccccaaatagcactggacttactcagccgttagatgtcgcatttttccgcccacttaaaattaagtggcgtgaaactttagattcttggaaaacaaaaaatcgtggaactgtgccaaaagatacatttcctcgtttattaaaaaaatatcgggagcgaatgggagagaaaaatctttggcggaggggaggggnttgatttaaaggtgcaggggtagttcgaggaaatcgaggagaggtcttgaagaggcttccaagtaaagacgcagtagaggatggcaaagaaagtgagaataccgttgcctgggtaactacatttcaggaatatttagaagaatgtagaacgaaaggga

SEQ ID NO: 7373 - DNA, 385 bp, Diabrotica virgifera
  Clone ID: LIB3026-003-Q1-E1-B8
cccacgcgtccggcgtttttcagtgttttattgtgagataaaatgaacttccatcaagtaacggtcgaatccatcaattacattgattttcagtatttaacgtaaatcttgaaaatttggataacacaagaaaaatatatttctaagctaacctcaaaattataaataaaaacaagcgtgaacgagtgtcatttgacggggggaggggcgcggacgaaaaagcgtttgatcagggggcagttggctaccactttgtggattgaacatgcgcagtaaagcagtacaatatctggtgtcaaaccatacaaaactacatgctagaacaaacctattagctatttagtcagattccgtttagtcgagttatccagtcaaacagattccg

SEQ ID NO: 7374 - DNA, 233 bp, Diabrotica virgifera
  unsure (1)..(233): unsure at all n locations
  Clone ID: LIB3026-003-Q1-E1-C1
cccacgcgtccgattaaacaatggcttccaaaactgttcttttcggactcttggtagtccttttggtcaaccactctttggctagagatctgactgtctgtcccaactcagacaaagcaaccaaagctgtatacgacaaagaagtagcaacatccgttgtaggaagcaccatccgtgttagagtgcganactggtcgttcttggantcgcgggggaggggggattgttatcgt

SEQ ID NO: 7375 - DNA, 328 bp, Diabrotica virgifera
  unsure (1)..(328): unsure at all n locations
  Clone ID: LIB3026-003-Q1-E1-C7
cccacgcgtccgggctatgcttgactcccaactcattcacaaacctaagcgaaacattacatcccgctttgtagctgatcctcaattgactgttccagaatcaattgactggagagagaaaggggcagttgctcccataagggaccaagggcaaggcggatcatgttgggcattcggtncancggcggctcttgaaggggggggggggggggnncanaacgtactaggagtgggggggggcgggagttagtagattgttccggtgaatacgacaatgaaggctgcaatggtggttggcccgattgggcatatagctacattagagatc

SEQ ID NO: 7376 - DNA, 224 bp, Diabrotica virgifera
  Clone ID: LIB3026-003-Q1-E1-D4
atatgatatgcacatgttattaaatattatattttctgttaataaatgaccttaatatataatttacgaaaatattacaaaataataaaatgacaaatcagttgcttccttttactataaatttatatttgtaactgaaaaattatccaataaatctatttatttataaaaaaaaaaaaaaaaatgggaaaatgaacgaaaaaagaaagggggcggggcggggg

SEQ ID NO: 7377 - DNA, 374 bp, Diabrotica virgifera
  Clone ID: LIB3026-003-Q1-E1-D5
ggagggggttgacaaacgacagatgtatgtaccgcaaaaatgtgtccacttagatcaaaaatcgacctatttcgtcatttccttaaaatctaataaatactgccaaatatcaaggtggattattttctttggctcacactgtatatattttaatattctacacagaaaaaagtcaggaacaaatttgtaatgctaatgcgagtagaggggggtattttttttttacaaaaagtctgttgtcgcaatttttacttatcacatctacagaaaaaagaataaagtgaaaaactgtttataacaaattgacgaatatttttattgttaaaagtgtcatttactgttaagtgccagttactatttttataagctagcat

SEQ ID NO: 7378 - DNA, 80 bp, Diabrotica virgifera
  Clone ID: LIB3026-003-Q1-E1-D8
ttcactcgtccggtttgacatacatgatactaaacctaaacataaattatacaaaattaaattttcttactattgtaaac

SEQ ID NO: 7379 - DNA, 182 bp, Diabrotica virgifera
  Clone ID: LIB3026-003-Q1-E1-E1
ctttttacttatttcaaaataataaaatattttttagtaaaagtaacgaaaaattttatttaatgatacttaattactattgtgagacaatattttatttttacaaaagaaaaatttattttttgtaccttgtgtatcacggattattaattaatacttatatacctattactttccaattt

SEQ ID NO: 7380 - DNA, 216 bp, Diabrotica virgifera
  Clone ID: LIB3026-003-Q1-E1-E3
ggtcgacaattcccgggactcattggaaatacagcaacatggccgtcaagattaccttcagcatccttatagcagttctattagccagaaacagggtcgatgcctcaggagttgcacctttatttgctccagcaccagtattagccccagcaccagttctagctccagctccagttttggccaaagtttctgatgccacaattgaccccaatcctg

SEQ ID NO: 7381 - DNA, 241 bp, Diabrotica virgifera
  unsure (1)..(241): unsure at all n locations
  Clone ID: LIB3026-003-Q1-E1-E6
gattaaaaattttcatattttaaaatatgttattatttatttttacatattattatttttattttttataaattttttattaaaatataaatttaaattatttaaatttagtaatgatgataatattagtattaaaacattgtatacttagtaaaaatatataggtttaataaaggaattcggcaccattcggttcaccggtctattaccnaccggcgcgcggcgcccccaatataaagtc

SEQ ID NO: 7382 - DNA, 183 bp, Diabrotica virgifera
  Clone ID: LIB3026-003-Q1-E1-F3
atgacgaccaagaattccacgctgtctttgactacaccacatactggcccacttttaaaaacctaggcatcttcgaagcaaccgttaaacaacttttccttagacatcactacaaaagaacctacaacatgaccatgattaacccacaatggactggaagaatcagcgcaaaaaaagtcccca

SEQ ID NO: 7383 - DNA, 190 bp, Diabrotica virgifera
  unsure (1)..(190): unsure at all n locations
  Clone ID: LIB3026-003-Q1-E1-F5
tgtgtgtcatccagcgtgcagggagctgatctgacgcttaccctgttttatgaaggattatgccctggttgtgggcaagttattctaacacagctatatccttcatacgctaaattggcagatagcttgaaattgggctttgtacgcgatggatgggtnactggtgacntatcncagggggggggggggg

SEQ ID NO: 7384 - DNA, 296 bp, Diabrotica virgifera
  unsure (1)..(296): unsure at all n locations
  Clone ID: LIB3026-003-Q1-E1-F7
cttgaaaaattattacaacaaggattacctctgtattttggaaaactagacgaatatgctaagaaacacaatggttacatagcttttgaaaggttgtcatgggctgatattttattcgtttgtgtatatgaagcattagtcaatcttgcaggtaaggaggctgtagcttcgtaccctagtttacagcaaggaganaatggtcgtctagcaacacgggggggggggcaggtggattaaaaatatgccatgggtaggggggatacgatttgaagcaagatcgttaagatgtttttaga

SEQ ID NO: 7385 - DNA, 175 bp, Diabrotica virgifera
  Clone ID: LIB3026-003-Q1-E1-G3
atttattttaaaataatacaacactttttagtaaaagttaacaaaaattttatttaatgatagttaactactaatgtgagagaataattgatttttaccagagagaaatttaatttttgtaccctgtgtatcacggactattacttaataagtacatatttagtaatttccaatt

SEQ ID NO: 7386 - DNA, 184 bp, Diabrotica virgifera
  Clone ID: LIB3026-003-Q1-E1-H1
cccacgcgtccggcaacaaaatggcaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtga

SEQ ID NO: 7387 - DNA, 310 bp, Diabrotica virgifera
  Clone ID: LIB3026-004-Q1-E1-A3
tcccggggccccccacgcgtccgaaaaaagggtggaagaaaaaaaaactgtccttaattaaatgtaaaaagaaatttactcttacgtttaaaggcctaaatttttttaaaaagacgagaaggacccacagaggtttagaacattattaaaaagtttttttaataataaatttacttacataatagggggagtcaacctgggggggctaaaaattaaacgccacctttttggtaaatcagtacactaaataaagacctctgggatccaactagtttgacgatattaagaaactaccttagggaaaaccccg

SEQ ID NO: 7388 - DNA, 192 bp, Diabrotica virgifera
  Clone ID: LIB3026-004-Q1-E1-A4
tccgggaaaacagcgtccaaatctaacttccaggtagggaaaatggcaatgacaggcttaatgaattaaatattattcaagtttgaactttcagtttaaaagagattatcccaagcagataattcaataaacaaacttctgggggtccattcctaaagaactggccttactaaagtgggaaaataccaactc

SEQ ID NO: 7389 - DNA, 413 bp, Diabrotica virgifera
  Clone ID: LIB3026-004-Q1-E1-A6
cttgacttcatatttttaaacatatgacataagcataaaatggcttctaaagcttcttttgtctccgtattgatgttgttggttgctgtaaccaatgcatatgatgtaacaaattgtccttcaaataccggtcgccagagaaatcttgtttacgacaatcttttatcgggagtgtctatcaatgttcgtatgccaccggcaggatattttaatagacccataacgtgccttcaactaattgatcgacaaggaaactccgtttccgcaaagataatgtgaggcggatatctcgatacatacatggtattcaatattacatcattaaatggtcaagtactttaataacaggcacaattatatagtgaataattaaatttctttaattgaattacatcgttattatacaggtatgt

SEQ ID NO: 7390 - DNA, 446 bp, Diabrotica virgifera
  Clone ID: LIB3026-004-Q1-E1-B1
cccacgcgtccgtccagacctagtaggttaactcagacctcttgagggaaagtggacgtatattatttattttgccaatcttttgcttgtacctaccactgtgcgtctaggtacctagtactagcaacatttgtattgtctaccatcaactttatatgcacacatgtttatttcttcactgcttaaaactaaataaagtcgttcaagtacttctgtaactaaaaactacacaaaatttacaacaaaatgttcggaaaatacaactaaaaaaaccgttaacggtaaaaaaacttaagaaacatggcaatatggttcaaataatataaaacaaacacaattgtttgacagtttgcctcccaaacgtcaaagtcttgccccattataatcttgacgtatgttaaaagcgccatctattgacaatttgtaaaaacttaggaagtaggtct

SEQ ID NO: 7391 - DNA, 444 bp, Diabrotica virgifera
  Clone ID: LIB3026-004-Q1-E1-B5
cccacgcgtccgcccacgcgtccggttcaaaatgatgcagcacaaggtaacgaaagtcaagctgctgcagaaaacaacagtaatgctgatggtgcccaaaataataataatggacctgctgaagaaaataattctaatgcagatacccaaaatgatgctgcacaaggtaacgaaaatgggtctgctgcagaaaatactggtaacgctgatagccaaaacgacgcaggacaaggttccgctaatgcagccaacgcagataataatgctaatacagacgctcaaaatggtgctgatcaaggtaacgagaatggatctgccgcagaaaacaacggtggtgctgatggtcaaaacgaaaatggagctgctgcagcgagcagcggtaacgcagataaccaaaataataacaatagcaataatgatagcggaaacaatcaagacaatggt

SEQ ID NO: 7392 - DNA, 261 bp, Diabrotica virgifera
  Clone ID: LIB3026-004-Q1-E1-D2
cccacgcgtccgcttaaaaataaacttttactaaaatttaatttttaactacaaattaggattaaaaattttcacattttacaccatgttatcacctatttttacacactaccacttttaacctttacaaattttttaccaacatatacatttaaacttacttaaattcagtcacgacgaccatattacccctaaacaaattgtctctttactaaaaatatctacgtttaataaaggaattccgcaacatttttttccccc

SEQ ID NO: 7393 - DNA, 384 bp, Diabrotica virgifera
  Clone ID: LIB3026-004-Q1-E1-E4
ccagcgtccgccagcgtccgcgcaaaaaaaccccacagagttaaaacctaacaccactgtagacagttttaccgtcgactggcacgttgcagatgtaaaatgcaaaatcactggtatgggattacttggagacacttatgctctccctattcaagaaggtattgaaggtgccctcaaccatggtcttatcggaaataccgttggagacttccttaaaatgagattcaacactgtctggtatcccactggcaaagtctggcaaatgctggattattgcaactccctcgtgtccaccccagatgcacgacaagcctagttttaatcaaataatcaggttaaataagaaggtattttcctttggaaccataaaatacaattaaatgg

SEQ ID NO: 7394 - DNA, 414 bp, Diabrotica virgifera
  Clone ID: LIB3026-004-Q1-E1-E6
acggtcggaatccggtcaccagcgtccgccagcgtcgccagcgtccgtattatttaaatataaatattttagtaaagtaagaaaaatttactaatgtagtaattagtatgtggagaaatttatttaaaaaagaaaattatttttgtacctgtgtatcacggattattaattaacaattacacatttactactttcgaatttaaaagacccaaaaaattaaaatttttattgtaaaataaaaattttaaaaaattttttgtgaagaaatgttaatcccttttaaataaaaccaaatttttaagaaataaattaaaatttattattaacaatatatttataattaaatatttttatattattaatattaaatatttttagggatgagcttaaaaataaaattttactaaaatttaa

SEQ ID NO: 7395 - DNA, 399 bp, Diabrotica virgifera
  Clone ID: LIB3026-004-Q1-E1-E7
attactacaaggcataatcgaggcaataataaaattaatagcaggtggcgtagtaagtgaaattaacaaacttctacaacaattagtcaatccaaatgcaaccgagtttattattgaggaactactggtccagcttaacaaaactcttgtaaattaattacctatatatttctatatatttactgtttaaataaattaaaaagattgtgtaaaattaaataaaaattatatttttcatgttaagctgaataaaataagcattatttaaaaaaaaaaaaaagataaaaaaacaaaaattattaagaaaaaaaataagaataagatataaacaataaaaggtataaataaatatgtcaaaaagtagaacaattaaaaaaaaaatagggggggcgccccaaa

SEQ ID NO: 7396 - DNA, 349 bp, Diabrotica virgifera
  Clone ID: LIB3026-004-Q1-E1-F2
gcttatcttcctgtaaatatagttgaaggcttcaactatgcaaacgtaactttaaatgataaaaactatatggctgacaatcttcagattctatgtttcaaaaaccctgatgcattgggatggcaatatacaaaagcagcaaactttgatgacttattgaatgattctaaaattgctcccatagtagctggttgggaggcacattcagtagtatacaatgcaacggtatatatgggagtgggttacattccaactttgggaggcaacaatgtacgaaaagtatatcacgggcttccacaaacacaaaacagaagggatggtagtttatacatagataggtcaagtgtgt

SEQ ID NO: 7397 - DNA, 453 bp, Diabrotica virgifera
  Clone ID: LIB3026-004-Q1-E1-F3
gtttttcttaaaaactatcaggtaataaacatattatataattgaatataatctgcttggcaaccctggtagaataattctaaattacaccatttcttgagaaatctaacacttgactgaattgtctttttaaatttaggatggatgttttgtgttcctaaagtagtaaattgtctttggtgaatgtcttaatacattttcttccattatggcaaataattcaataacataagttttagcacacaactgccgttttataggcctatatttacctttacctaatgtcaattaacgttagtctgtatgcgtattttctgaaaggattcaaaaactattttacgtaaacacgttatcccttattttttgctcaatgcgcatggcaagtatagccttttacgtttaacgtacgtcaaaaaggtacagggtctaaaatctctctaatatggacccaag

SEQ ID NO: 7398 - DNA, 425 bp, Diabrotica virgifera
  unsure (1)..(425): unsure at all n locations
  Clone ID: LIB3026-004-Q1-E1-F4
ccaagcgtccggtcaaactatcaaggtaccaacacagcgccttttaaaatgcgttcctggtacaaattgggacgttattgatacagacaacaaatttgcgtgaacctgcaatgacagctggagttgaatgtgaaaaacagtgttgtccttaatgacggaagttcttgaaactaaagacttttcacataatttgtacagtctcagtgcagctgtcagtgtagtcacgtttatttctaacgtacgctatgagaattatttaaacgtatgtcgtgtatgttttttacggatcatttccacatcaaactggaggttggttgtcggtatttgagtgtcagtgtaaagcgacattgatggttctgacaaatgaagcgaaggatgaaaatagcgattggtgacttaatgtanctgacgtaacctgttaataa

SEQ ID NO: 7399 - DNA, 421 bp, Diabrotica virgifera
  Clone ID: LIB3026-004-Q1-E1-F6
cccacgcgtccgaatttccttggcacttgttgcttgcgatgattcagttagtacttcgacagacactccggtaatatcaacagaggtaccagcaccgatatcgacaagccttcgtgaagaaagactttacgtagacacttcaaatgttcccgatccagtctaccagatagatgccgtggaagcattcagagaagctaaggcacttcatccagttgacggtatagctttgttaaaaacattctccgagttgtttaacgccagacataaagtatctggaggatggaaagttgctgaaaaatatgactacttttacaatccaaattataactacgtgtacgttgcattgggagttatagatgctaatggacataggcttgttctgatatttaactaaaaaaattaaccattttaactggtaact

SEQ ID NO: 7400 - DNA, 396 bp, Diabrotica virgifera
  Clone ID: LIB3026-004-Q1-E1-F7
aaatatttagccaaattcgatgatatattcttctagccgtgcttgtttcaaaccattccgggtggaggcggaccattttatagacctttagagctcactgagatggttttgctgtcaccccaccccttgctgagcacgacttggaggagaatgtatatagttgtacatttatttatttttttgattgccgtaaataagttcaacatcctcgcccgggcgaagtatagactatatttttgtcattcggagactgcgaatattgctgtttctttgtcgagttcatgtagagttaatcattttgagttgtgcggatcgcaaatgtaccgttgttatatttggttaaatgtaactaaaatattctttaaacattgtatcatcatttcactgatggttaat

SEQ ID NO: 7401 - DNA, 403 bp, Diabrotica virgifera
  Clone ID: LIB3026-004-Q1-E1-G3
gatatttgtcaggttatttgaaatatttacaagatgaaacccattgttttgtgtattgtgatgagttcaacatctaaagctattccaacagccagattaaccaatgatgatgccaacttgggagattttccagggatcgtcccattgattatttacgcccgtatgccatggcatgagataacgtatcacgaatgttgacgcgtacgtgtaagcatatcttgggttttaacttcagctatatgcgtcaaatctaacgcccaatggaatacactgtcagatatctacgctggtatcgtacgacaatacgatccgtcgcgtcaatcatttacgatttcaagaactgagcgacaacctggttttaatactgatgaatctcgcaatccatcttttgaccaaactgctt

SEQ ID NO: 7402 - DNA, 428 bp, Diabrotica virgifera
  Clone ID: LIB3026-004-Q1-E1-G4
cgtttttaaaaaaatatccttcctgggaagaagttaattggtttcattttcaaatttcataattagaacgggctttaaaaatgtccatctattttagcggtggttttactaggtcagccgggataataagtgccataaataaacaactaaaattagttaacttaaaacctgttaaaaagattcaggttcaatttgatccattccatgccaatgcggtaaccgctcgagatttccttttccatatatcaacaccaaaagtaatagaaacaaaccttaaattgtgtgataaaaccaaatgttgtatgtgacaggagtgaaccagagataaagattgacttgggagatgcaggcacagtgaaatttttagccaacaacttgacagtcttagaaatactgcagcagttcaataaacacatcagctccaaagt

SEQ ID NO: 7403 - DNA, 445 bp, Diabrotica virgifera
  Clone ID: LIB3026-004-Q1-E1-G6
attaaaacgtacgctattaatatatttattttgaaattagttaacagaatagtttataaaggaatttcgggaataaagctaagattttaatttaattattaaattatcaatttcgttttattagaattcaaatataacaagctaaaaatgcgagcattattataacgaaaactttgtttatttatgtatttaaattcctaatatggaaaattgctatcatgaaaagttgtttagaattaaacattttgtttttatgtgtaatttaaacatgttttaatgtgaaattcatatttttttacataactcgactaaaatcgattcaattttatatatgatgattgcatcgtcgattttataccatgcagatctttttatgaagactataactttatctcgtaaaattacaaataaaaaagtgtcccgtaatataagtgtccaacttaag

SEQ ID NO: 7404 - DNA, 354 bp, Diabrotica virgifera
  Clone ID: LIB3026-004-Q1-E1-H4
acgcgtccgatatgatatgaactgtcaatgtaataattaggaaatggctattatcagtggatgtattttataaagttatattgtacatttaaatttatctatgttccaatatatttaacacaatataactttataaaagaaacacaataaagttataaattccaataaaaacaataaatgcactaatatcactgtcactgaaaataatgtagattaaaattcatagtaaacaatgtatcaaagaaaaaaaaaaagaaaacaaaaattaaaaagaacaaaaaaaacaaaaccatacactaagcgaaaaagggagcaacgggagtgaaagcgaaaaaaaaaaaaaaaaaagggggg

SEQ ID NO: 7405 - DNA, 194 bp, Diabrotica virgifera
  Clone ID: LIB3026-004-Q1-E1-H7
gtcgaaaaaaaaaaattgacgtgcgtgataacccacgcgagaatctcgtaattgcgaacgacgatcttcggccgtcaacttttataaaaactcaaatatttacataaaaattaggagttaacacttttcatttatcaaaatatcttcactaccttacttccacatacaattacttttactttatacacattttt

SEQ ID NO: 7406 - DNA, 455 bp, Diabrotica virgifera
  Clone ID: LIB3026-005-Q1-E1-A8
catctctgtttggccacaaaatatagcgctgaaataataatactgcataattttgtagcagtatgtctacccttattgctgttacggactgatgatggcttattttcgtaacctctttttctgtgcatactcggcttaatcgaggttttctttactacagtatgcggcaaaataagcagtattgaaatgaatattatattgaaattattgaatattatattaaaatgaatatataccagtaactgaattgtagagacaaaagggatacaaactgaaacttggaaaaatatttcaaaaaactcctacaaggttaagactccaaatgacgaacacgattacaatacagaagacacgtatatcactaaagaaactgaagtagaagcgagaatgaagatcttaaaaaatagacgatcgccaggtactaattctattccccctttaaatttttttttttt

SEQ ID NO: 7407 - DNA, 440 bp, Diabrotica virgifera
  Clone ID: LIB3026-005-Q1-E1-B10
aattaattaaatttacctttatataataattgacgatttgattgggcaatcgttactttaacgaagggggaagtcatgacatcttaactactttttttctgtctcctctagttttcggtatacactgcgaaacataccaatttgtgacaccctgtacattgtaccttgaggggtgtaaaatcaaagtcggcaatctcccatttccataattttgggaaaccgcgaaaatctgtagaaactaacaaaattaaattaaaacaataaaactgatgaagaatcaaataaaatttggtttgtgatcggatgtacagaaaggggagcttaagaacacacagtagcgatcaacaggtagcaacaaacgcggtgattgcgacaggccgttggcctaggtcgctacaatttctttatggttatatccgtttcttgggtgtgaatccgtc

SEQ ID NO: 7408 - DNA, 385 bp, Diabrotica virgifera
  Clone ID: LIB3026-005-Q1-E1-B11
aaacttgaggatgtccctaaagatacaacaatagttgaagttaagcctgctcttaatgaaagtgtagaccatgactactgttttgtaaaaccacaaatagaagaagaaaaagtggaaccaatacctgaaccaccggttgaacctcccaaggtagaagcgaaacaagaaaaaaaacctggcagctcctccagtagtagtagcagtgattcggactcatccagttgttcatgtggttctaattgtacctgtagttcaagttcaggcagctccagttcgtcgtcagatagttctagttctgaaagttcttctgaagaaggtaaaaagaggcaattagccaagaagcagaagaggaaagaaagagcgaagaaactgaaaaaaacaaaaa

SEQ ID NO: 7409 - DNA, 409 bp, Diabrotica virgifera
  Clone ID: LIB3026-005-Q1-E1-B12
gcagtaggccctataagtagaactataaggagtcgtacgcaatatatcaattcagaaacaaatgagacacacgttctagaaggagaagtacaacaaggttcaacaactggggaaggtcgatttctagtacatttcttaaatccagacgtagctgtacctttctatgttcttggtacagactatgaaaattattctgtaagtttcgtctgttttgaacgtaatggtgtttttctacagagtcttttccttacaacaataactccagttccaacacgagatgagatagatgcgattatccaagttcttgacgacaacgatattgatcgtgagcaaataatcgatacagaccaagatgattgtacttattacaacgttattagattaaaatagaatacgagtatattatctg

SEQ ID NO: 7410 - DNA, 370 bp, Diabrotica virgifera
  Clone ID: LIB3026-005-Q1-E1-B3
gtcgaccacgcgtccgcagatgcatcaggatctgcattccgatgtgttacgcgatatgatttaagcatacatacgcgtcggtaacatatgttgcaacctccaacttggtaagtgccgattctgaatcactagcttctacggtccgaaagaaagacaatggcaacaacgatggcgcatgttcctcctccacaatactagtcacgatgatgtcacggcctaggatgcacatcatacaggtgtccacttatcaactggtaattttgatctcgtttaaaaatcacaatgagttgacatatgaagagatccataatgagtctgagatatcataaatggatccaattagggggttacagtcgctggcaatgggtaa

SEQ ID NO: 7411 - DNA, 289 bp, Diabrotica virgifera
  Clone ID: LIB3026-005-Q1-E1-C10
caaaatggcaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgt

SEQ ID NO: 7412 - DNA, 101 bp, Diabrotica virgifera
  Clone ID: LIB3026-005-Q1-E1-C5
aaaaaaaaaaaaaaaaaaaaaaaaaaaaaaaaaaaaaaaaaggaggacgcactaaaagaataggggggtagctcgacaggcatgaaacttcattactcttc

SEQ ID NO: 7413 - DNA, 432 bp, Diabrotica virgifera
  Clone ID: LIB3026-005-Q1-E1-C7
atgtaaacccatcttaaacgtactttcaatagactgttctaacttaagtcgagtgtttgccgcgaaagtggcaagttggacagtatctgtcaaaaggttccattttcgtatttggcagaccctttaaatacttttttatactgtttgttgtgctacataaattcgtgtgaagttttcttatgtgtaccacgaattaaattgcgtgaatgagaaagtaagagccaattattttagtctcgtatagtgatcagaagtggttttagggggttgtgagattatgtacgtggctccttaaaatcaattgtgattgctgaactgatctgcatttaaatccgatagaatgatcgatatagtttatatgacctcagatgtacctatattgttgtaaatatatggttactttttaaaaacagaaaaaaaaaaaaagggcgg

SEQ ID NO: 7414 - DNA, 359 bp, Diabrotica virgifera
  Clone ID: LIB3026-005-Q1-E1-D1
cccacgcgtccgaataccaatatttattcatctgaagaagaggtcaacttaagtatatataatagtgttaccatgaaagcagtgttcatattttccgtggttatattcgtaactatggttgcaacagaaattcgtgaggatcatgagtgtatctgtcctgagtactgggaacctgtgtgcggaacagacaacaaaacctattctaatccttgcttcatcaactgcgaagctcaatatactcctggactggaaattgcctaccgtggatgttgcgtggatgatccagacccatgtgcttaatatgtaaacatacattgtagcttaaatttttttaaaattattttgtagtttaaattttt

SEQ ID NO: 7415 - DNA, 321 bp, Diabrotica virgifera
  Clone ID: LIB3026-005-Q1-E1-D2
gaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataat

SEQ ID NO: 7416 - DNA, 453 bp, Diabrotica virgifera
  Clone ID: LIB3026-005-Q1-E1-D4
catttttataaatttaaacctgacaactgtaattcaagacttatatgcaagatatttaaaaaatatatataaaactcctaaaaagacagtttatataaattttttaaatatcttgcatataagtcttgaattacagttgtcatttttataaatttaaacctgaaaaatacattatttcgcattaatacctcatcctgttcgatagtttcttaagatagataacaaactgccagttcgataagttttcttttaactaacacaattgtttattagtataatataattttgaaaaattactgtactgttgtccccaaaacattaaagtgttctgcatttatttaaagaataataaactttttatattaatggtagttcttttgtttttgaggtttttcactcagctgtttacgcttgttttagttagataggtgttgcaaaaactatagggataaa

SEQ ID NO: 7417 - DNA, 306 bp, Diabrotica virgifera
  Clone ID: LIB3026-005-Q1-E1-D9
atcagaaacgtatcatggactggattaatcggtgttgcaagcacccatatcgaactcaataccaataaatggtatggtcttgccgattgggatatctcagctaagcaaatcaatgacgacgaagatttcgaggctgtctttgactacaccacatactggcccagttttagaatccttggcaactacgaagcaaccgttaaagaacttttccttacacagcactacaaaggaacctacaacataaccatgattaaaccaaaatggactggaagaatcagcgcacacaaagtctccactgtcctaaca

SEQ ID NO: 7418 - DNA, 407 bp, Diabrotica virgifera
  Clone ID: LIB3026-005-Q1-E1-E10
tggaaaaattagatatatttcgtaagaaattaattaaatttatttattaacattaaattcaagtaccaaaattttgttaataaacaaatttaccattaaaaatttttaaaatattaatattagatacttttagggatgagcttataaataaaactttattaaaatttaattttcaaataaaaattaggagtcaaaatttacataatttaagacatgtcaagatttatgttcaaatattattaattatagttattagccattttatagaccaaaacatatttaaattagttaaatttaatcgagaagatacatttcgatctccaaatatgtatatcgagtacaaatcgagtagtttaacggatgaactcggcaacatatttttcacctgtttaatgatcccatgtcaa

SEQ ID NO: 7419 - DNA, 124 bp, Diabrotica virgifera
  Clone ID: LIB3026-005-Q1-E1-E5
cacgcgtccgcatcatctttattcagccattaaacctcgttctttctaccacacttgtcatctccccttttaaaacaacctcactactggcgttaccttctgttctatctccactactctccgg

SEQ ID NO: 7420 - DNA, 446 bp, Diabrotica virgifera
  Clone ID: LIB3026-005-Q1-E1-F11
cccacgcgtccgaattctccctggagaatatagaaatattttaacacctgcatctaaaataataaatactacccaaccagcagggaatactgcaagatttagcaataaaaacaataacgaaccatctgcagcaataagaaattctgtaaaagctggaaacagtacgccacaagctgggacatacacatcaacagtatttcgttcatggtcatctaatccacacttaagtcaaaagacaaactcatttaatagaatgcctagtaaagcgacacataataaaatacaaccatcatctagaacaggggtttacaacaggcggcccgcgaggcatatgtttgcgtcacgcgagagtatttacacaagtacagaattcttagatgattattattaattgcattcatgtaagctaatttaaataaataatattaaaagcaaaaaaaagaaaa

SEQ ID NO: 7421 - DNA, 344 bp, Diabrotica virgifera
  Clone ID: LIB3026-005-Q1-E1-F5
tacattttcaactataaataaattattgtttaccaatagacaactgattactgattaacaaataatcaacattgcacttatcttttaaaatgagactgatccgttcttaagttattctagaataggcattttttattttgtagttttgtgacagctaatggactaaaccaatattttcttaagtgtattttttaagcgttttactaaataagaccatgtaattttgttctgatctggtaacatactctgtaaggctgtttttggatttatttttatattactagatttcattatatacaaccgaaggatgagaatctttcacatagacagttgtgctgtttttg

SEQ ID NO: 7422 - DNA, 442 bp, Diabrotica virgifera
  Clone ID: LIB3026-005-Q1-E1-G10
taaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagtagagtctggtagaggacatagtttggattattacgtaaaagtttacgctaagtaataaatgtattattttttatattataaaataaaatacatgaaaat

SEQ ID NO: 7423 - DNA, 414 bp, Diabrotica virgifera
  Clone ID: LIB3026-005-Q1-E1-G12
taaggcgcttacattacataacacacttcaaaaactaaagttataacaatctgttagatgttgatagaaaaatcaaattctaataatctaaaagtctacacctacagtactacgaatgaatgcagttccaactaaaagtttactggggctttttaaaacaggatggaatgaaattccagaaatcatgggcagttcaccttttgggttaactgggattggattaacagcttattcactgtagttatactatcaaaatgacggcgacaacagaaagtataacgatcagtacaccgtttatagacatgatgatccaagggtagcaaaattaaaaccataatacatttataaaataattagtcctgtaacaactttatttcatgtaacattcttaagataaatacattattaaagtaa

SEQ ID NO: 7424 - DNA, 452 bp, Diabrotica virgifera
  Clone ID: LIB3026-005-Q1-E1-G6
gatgctgattgccaagatgtggaagatgaagaggaggccggcaatgaagttgaggtgatagatgattccagtgaagtgccaaatcaaagtgagagagaagaagataacgtggaagaagaaacttcagaacaaccacagtctgaagcaataagtagtggcactgatggtaccggaaggagcgtacccacgacaccgctacagtcttctccacaagaaggaattcccggtagtgaagagcaaggtactagccaacagtcagatgctgaaaccccatcgattgtaataagtggcgaagttgacgataatgaaaccataggtgaaagtagttcgggcgatatgggtcccccagctgtagctggcacctcatcagaaggcgcccagcagcacgaacaagccgaagaaatgctcgaaggtgacgatggtgtaagtgtgattgattaagagaaactttc

SEQ ID NO: 7425 - DNA, 385 bp, Diabrotica virgifera
  Clone ID: LIB3026-005-Q1-E1-H12
tttaattaaatttttaaaaattaacttcacatattagtcaaaattgtaattattaactttatttaacttgaacttattaactttacttaactttaacttattaactttatttaactttaactttaatttattaaattcatatgaacttctggattccaatccctcagattagtttttggtttcacttgttattattactattataaaccacgagttaggaaaaggatctgtgtatccactcgtaggtttatttattcaataaggcttgtgcctgtcccactcacagtgaggtatttatatgttatatatagtatcaggtagtatttaattaaggcgtacgtattataaacgtacaattattatttggtgagggttctactaacct

SEQ ID NO: 7426 - DNA, 364 bp, Diabrotica virgifera
  Clone ID: LIB3026-005-Q1-E1-H2
ggcagtcgacagggtctaacagtgttaggcgaacgatggcatagataagcaggtcaatgttcatcatcagtatgccatgccaccaaataagagcacttcagctcaaatacactttgcagggatctacacgttgacagttcacggaataatgtgtgacggtatcgccattttgacagatggagacaaattgccgaagagtggaggggtagaccttccaagaacatccttagggaaaacgtctcttaggaaaatgtcgatagcagaacattcttcactcgagatatagagggtacacgcaacatgaccgctttacttgccatagccctacagatcggtcataacgcattcttcacttcctttctcg

SEQ ID NO: 7427 - DNA, 245 bp, Diabrotica virgifera
  Clone ID: LIB3026-005-Q1-E1-H5
attttagttttcgtttatattattcatatttttatataaaattttgtgagccaatgtttcttgggttgaattctttattagtggaagtatttatacatataaaatagataaacagtgagatattaggtgatgtagttttgttatttattacatattttaattattttttgtactaattttaggaggtatttgttattgttaaaataattaaacgaatatgttaatatatttttactttcatcctt

SEQ ID NO: 7428 - DNA, 423 bp, Diabrotica virgifera
  Clone ID: LIB3026-005-Q1-E1-H7
gccgcccccgctccagtcgtcgccgctcctgctagagttgcagctcctcttgtagctcctgcagctcttccatacgccgctcttccagctgcttacagcgctcttcctgctgcttacagcgcatatcctgctgcttacagcgctctcccagctgcatacagcgctcttccagctgcatacagcgctctgccagctgcatacagcgcattgcccgcagctgctcctttagtagtcaggaagtaagcgaattaaaggaaatttggccaaatacaacataccaactgttatgaaaatatctcttgctacggtggcatatagttaatgtattataaagaaacgttgctgccttatcaggggtgaatgacctgtcgtgttaacagtgtatatttgtgagcctttaggtaatttttaaataagtaattt

SEQ ID NO: 7429 - DNA, 364 bp, Diabrotica virgifera
  Clone ID: LIB3026-005-Q1-E1-H8
accatatgttgttctggaagtcaatgaaaccaataaaactccaaaaattaagttagataacgaggttattcgaaaatttcatttcaataatgttaaaccattttatgaggttattaactaaacgaagttgaagtgtaacacggcaagtagtagatatgaactttcattttccatattataaatgactttaatcagtaataattgcaacatataattcgattaccttgtggtacacttcatctacggccttctcacaacaacacaaattagaatgagttattgccggtgggtttccttgtttcaagtggccctaactgccctgttcggagcatatccagagaggctctaaactacaagcccaaaa

SEQ ID NO: 7430 - DNA, 339 bp, Diabrotica virgifera
  Clone ID: LIB3026-006-Q1-E1-A1
cacattgtcgatacccttctaatgaaattacgtatgatttcgttcctggtaattgctcagaatattacgaatgtgaccacggactcagatatcttgaaacttgtcctcacaatagattatggaatcatatcaaaaactattgtgattttcctgaagaagttgactgcagtcgtgctccagttacaactaccacatctggaccttctactaccccaaattcaatttgcgatggccaaaaagacggaacctttttcgcagatgaagatgattgtgcgaaatattacgaatgtgtacgaggacaggctattgaatttacatgcccacctggtactttgtggg

SEQ ID NO: 7431 - DNA, 410 bp, Diabrotica virgifera
  Clone ID: LIB3026-006-Q1-E1-A3
cggacgcgtggggtgaattgctcaaagataattccccttccacatccagtgtgcacggattctagaacaacgttctatatttacccttacaactgcaaaaaattttatgagtgttacgaaaatgtgttgtacattcttgaatgtcccgatgacttactctggaataatgatgctaaggtgtgcgatgatagctataacgttgattgttcatacatcatacctgagaatgctgaaacggacgagccaacttcagccccaacttctacttctcctgtaactactgagcgtccaacaactacaaccgttcctccaccaccgactaaaccaccagttcaatgtgagcattcacggcaatacattcctgacccttacaattgtagcatgtattacgaatgttcaaatggagtacc

SEQ ID NO: 7432 - DNA, 213 bp, Diabrotica virgifera
  Clone ID: LIB3026-006-Q1-E1-A7
tggtaacaattaataacaaagatgctacgcagtgcgctcgttccttaatatatttggattcgtgagggcagctttgcacggcaacatcgaagtgcattgcagcttggctaggtattgtgaatgtccttatcatgccttcatcaagaatacttgttaagtttttacctgtcatgattgcccacaggtatcttggagaatttgcgattgtacgca

SEQ ID NO: 7433 - DNA, 429 bp, Diabrotica virgifera
  Clone ID: LIB3026-006-Q1-E1-A9
gcagatacatgatgcaaaccaaaaacaaattgtaggtgctgaggttaaaaaggtttatacaaatggacaattccaagatcatctcggagatgccgttgaatttttcagcgatacttcatttggaagacctattattcaacatgccaagctacaatcccagtttagtgacgtatatttttaccacttttcctaccaaggaactatcccaggggttcgtccatactacgaaggagcatataaggtagctcatggtgatgaacttcaatacgaatgggcaattggtaataacacgaatttgaatacctttccaccaggagatgttttaacaagccaaagataccgaattctacttagtaattttgccaaaaacttgaacccaacatctgaatctactgacattttgggaataaactactgggcaacccttaa

SEQ ID NO: 7434 - DNA, 265 bp, Diabrotica virgifera
  Clone ID: LIB3026-006-Q1-E1-B2
gattaatttaaactaataaaaaatttttaagcaaaagtaaggaaaaatttaatttaaggatagttaattagaattgtgaaagaatattttatttttaaaaaggaaaaattaatttttgtaccctgtggttccagggagtattaattaaaattaaagaattactaatttccgacattaaaaaagcctaaaaataaaaattttactggtaaaataaaaatttaaaaaaatttttttgtaaagaaatgttaatccgtttttaaatata

SEQ ID NO: 7435 - DNA, 406 bp, Diabrotica virgifera
  Clone ID: LIB3026-006-Q1-E1-B3
atttctattggatgtttaagttttatgcattacgtttcaaaatgcattaagtttcaaaagcaacttaatgcattaagtttcaaaagcaacgtggaccgtataaagaaaaaattttcataccattagtaaacaaaggtaaaattttctgaggtggctctaataatatgatcacccactgcatacctgtaaatttattataacggaatcaattttgcttaaaatttggaattagacttattttacccccctcttcataagttatatatatgtgctagctgagatttttatttgtaaggaatgaaaacaacctcatattgaaaaaataaatattaaagcgttttatagatttaaatcaggttagattaggtaattgaaatattttcaattgtagtaatgattgttttat

SEQ ID NO: 7436 - DNA, 277 bp, Diabrotica virgifera
  Clone ID: LIB3026-006-Q1-E1-B5
gttaaaagttggttttacagaacaattcgtggtactctacggtattccgagccccatcagatgagtatttaaaacggtatgcctttttaagagattgtgccataacattattttttagtactttacaaaagtgtttgtctgcaaaaattctgttttggaataagcagcattgtgagctgctgatattcatggtttggaatctactcttgaaggtgattactaattaattcgtttatactatatcattgcacatcaaaaattgcctgtaaatcaaatc

SEQ ID NO: 7437 - DNA, 264 bp, Diabrotica virgifera
  Clone ID: LIB3026-006-Q1-E1-C2
acaaaaatgaaggctgcaatggtggttggcctcattgggcatatgactacatcaaagataatggcctctgtctaaaatccaaagtacaaatatcaaggatatgacggttactactgcaaagagtgtattcccgctatcaaaaaaatcaatggctattcatctataaatcaaactgaagaagcacttaaggaggctgtgggtacggctggcccaattgcagtatgtgtcaacgctaatgacgactggcaactgtacagcgggggt

SEQ ID NO: 7438 - DNA, 348 bp, Diabrotica virgifera
  Clone ID: LIB3026-006-Q1-E1-C3
cgtttttaaatatagctaattttttaagacagatcttaaatttaattaatagcaatagatgtacaagtaagtatttttatattattagtaggaaatatttttagggatgagcttaaaagtaaaattttagtacaatttaatttttaaataaaagttacgatgaaaaattttcacattttacaatatgttactacttatttttagacctcagtatatagactttttacaaattttttagtaatgacagaaattacattatttagagttagcagtgatgataacattagtatgaaaaacatgtatatttagtactgatatatcagtttaagagagggaatctgcaacatt

SEQ ID NO: 7439 - DNA, 380 bp, Diabrotica virgifera
  Clone ID: LIB3026-006-Q1-E1-C6
cactttcatactcttgccagttatcattgaaataatgttgccgaagaaacacaattttgtgaaattccaaaaagcagctccagcgttggctcttttgtttttaagttacacgattttatacttttcgctgtacttccgtcatggtgtgtggctatatccagtgtacaaagtcttaacatggccacagagacttctctttagcgcggctcaactttgtggggccttgggataccaaaaattaggaatagtattacaaaattccaaaaggtcgcaaaacaaacaaaaagttaaataacgttagctgtttgttgaattttatctaaaaaattatttatatcatcttttttatatatttttatagaataaaatgttttattatc

SEQ ID NO: 7440 - DNA, 245 bp, Diabrotica virgifera
  Clone ID: LIB3026-006-Q1-E1-D1
cggacgcgtgggcggaccgtgggatttatttaggtataatattttagtacatagcgaaattttattaatgatagttaattactattgtgagagagtattttattttcataatcagaaacaattaatttttgtaccttgtgtatcagggattatcaattaataattatatatttattattttcgaatttacaatagctaaaaaattaaaatttttaatgtaacatagatactttaaataatttttt

SEQ ID NO: 7441 - DNA, 248 bp, Diabrotica virgifera
  Clone ID: LIB3026-006-Q1-E1-D3
aaaaaattaaaatttttattgtgtaataaatatttaaataaattttttgtaatgaaatgttattcctttttaaatacatccaattttttaagaaataaattaaatttatttattaacaatatatttataattaaatatttttacattactaagattaaatatttttagggatgagcttaaaaataaaaatttattaaaatttaacttttaaataaaaattaggattaaaaattttcacaatttaaaat

SEQ ID NO: 7442 - DNA, 151 bp, Diabrotica virgifera
  Clone ID: LIB3026-006-Q1-E1-D7
attgaaagcgggaatgaagggtgggatgaaaaaaaaaggccttaatttaattataaggaatttaattttaaggtaaaaagcgctaaatttttttaaagaggcgaaaagcccctagagggttttaaaaatttataaaaaggtttttagagta

SEQ ID NO: 7443 - DNA, 285 bp, Diabrotica virgifera
  Clone ID: LIB3026-006-Q1-E1-E1
gtccgttacgagtatctttacattgatttatattaatattgtattgttaacgctatttgctttagctcaattttccttcacaagaaattggttgatagaatatccccaaatcttttcttttggctacgtcaaaaaagaagagcatccttctgaagaagtcaaagcaggcggtcgctatcgtctaacattgtatggagaaggatggaaagagaagctggcaaatgtaaacgatcagtacgctatgccacctaacaggagcattttagctcaattacaatttgaaaa

SEQ ID NO: 7444 - DNA, 418 bp, Diabrotica virgifera
  Clone ID: LIB3026-006-Q1-E1-E10
caagatccaggtcacggtcgcaaagtaagaaagacgaccgagaaaaatccaagtctaggtctcgttcgaggtccaactctcgcaaaaagtcagacagatccaggtccaattcacgaacgaagtcagtaggaagtgatcgttcacgttctagatcacgttctagaaccccagataagcgttccaaatctcgtgaagcctccaaagaaaggtccaggtcaagatccaggtccagatcagagagcacggacagaagtaaatcaagaagtagatccagatcaccaaactaacactgttacgagtttgcaaccacagtaaggtttatatttgtaattaatttttaataacaaaaacacagtaaattttaattaagtaaataaaccagaacaactgttagcagtagaaattgtgaaataatttt

SEQ ID NO: 7445 - DNA, 304 bp, Diabrotica virgifera
  Clone ID: LIB3026-006-Q1-E1-E4
tattttaaataagttttgcgtaatgaaaaggttagacgtttttacatacaacaagttttttaagacccagcttagatttatttattaacaggacatctatgattaagtatttttatatgatgagtatctaagatttttagggatgagcttaggataaaagtttattaaaatttaattgttaaataaaaattaggagtaaaaattttcacattttaaaatatgttactagttagttttatatatcattacttttagtttttaaaaattttttactagaatataaatttacattaggtaaatttag

SEQ ID NO: 7446 - DNA, 415 bp, Diabrotica virgifera
  Clone ID: LIB3026-006-Q1-E1-E6
gaaaggttccacctagagactacgtcggaggcgaagacaacggcgagtcccccaacctcatcaggtctcagttcagcggaggtcaccgtccaagcaaactcgttcaaagccaaggaatcggttacgtcgcatggggtgaggaagaaaactccgtcaaagaatatgaggtaatgggcgaattcaccggatactgggttgccatttcaccaggaaacatcccatgaaacgctttatcaggggtacagaactaagatggtgaacgtcactacgtacgaactgtcgggcatgacagagcattgatcgttggaaatgtacctaaccccatggagtcagttaaatctcatactggggtcaagagatgtcattcccatactacaaaagtttggtaaactaatcagaatcaaattgtttaagc

SEQ ID NO: 7447 - DNA, 66 bp, Diabrotica virgifera
  Clone ID: LIB3026-006-Q1-E1-F2
agcactgtttttcttgtttttccaatcaatcacaccctcattgcttttctaagttaatattacgac

SEQ ID NO: 7448 - DNA, 425 bp, Diabrotica virgifera
  Clone ID: LIB3026-006-Q1-E1-F7
gacaaaagttgaacaaaaagaagctataaatacagaaggaaaacaagatacagaaaaggaaactcttgataagcagaaagctgatccagatactgaaaatatatccgaagatgagcttcctgttgttcaagctgtaaaagtaccagaagctgaggaagtttcagatgaagaacttccagggcccaaaagagctgagcttcctgcagatactgaagtcgtctccgaagatgagctccccaccgttaaaaatgattccaaaaaagaaagtaacaagagaaagcttgccactgattacgatcctggatccccaacatctgaaaatgaggcaccttctaaaaaaccatctcttgatagttcggctgaaaaggacaaagaagaaaaacctaaaccgaagaaattaccagaacttgataaatactggaaag

SEQ ID NO: 7449 - DNA, 440 bp, Diabrotica virgifera
  Clone ID: LIB3026-006-Q1-E1-F9
ctctctattattcctctactttcaccttgctgcattgcacagtgtcggtctagcagcctttgaagatggaggtcccgatcacggttacgtgaaattcgttctttgattcattttttaaatgcaacatggattatataaagttctttattgaataatgtagttatttggtttttattattttgtacgtctaatcgaatttgattttcatcattggtaactaactttaaagaaaataatgttgatttcatattagctggtcattcaaatgtggctttgtggcttttgagatatttaaacaattattaggtatccaaaaagcctttcttgaagacctgctttaatttgccgtcttgaacattttgtttgttagttaatgtcgaaagttttttttgatggaatattattaaaaagagaaatgtactctgggcttgcacatattt

SEQ ID NO: 7450 - DNA, 91 bp, Diabrotica virgifera
  Clone ID: LIB3026-006-Q1-E1-G2
aaaaaaaaggggtggccgcccaaaaggtataaacctaacatacccgtaaaggaaatttaaaacccccccaaaagttcccccaatttaaatt

SEQ ID NO: 7451 - DNA, 429 bp, Diabrotica virgifera
  Clone ID: LIB3026-006-Q1-E1-H1
aattcgaccttggtctgtcttaagctcattgttgtaaagatattgaagcagattagggtaaactttttgaagtgtgtattgataaatcaatcattaaaataggtctataaaaggagattttagtttaacattgaattacattcgtgtgagtttataaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttct

SEQ ID NO: 7452 - DNA, 449 bp, Diabrotica virgifera
  unsure (1)..(449): unsure at all n locations
  Clone ID: LIB3026-006-Q1-E1-H2
gtccagggacacgtccgcataagtaaccatgaacgccgatgtgcctgaacaaatagaaactaaatcagagatactcacaaggcataaacagacagatgacatgccccaagttcctattataaaagaaaagattgatacccacacagaactgatgttggaaccaaagtctgaatatgtagaagaaatgaatgaggatagtattgaggatttgacactggatgatgacgatttaagtaatatggaacaggtatatgatcaagcaggacctagtcatggagcaggagaaggatcaagtcaaggttttggaggttggcatatgggtaaccaaagtcaagatgaagtatttctggccgcgcaagaggccgtangtgcacatcgagactcacaagattctgactttctgacttgtcatcaaatgttttacaaattcagaaccaaaaattctctga

SEQ ID NO: 7453 - DNA, 345 bp, Diabrotica virgifera
  Clone ID: LIB3026-006-Q1-E1-H4
aaaaactctgaatatttggacgtgcactgacaatatgtcgattttattgcaaggcactcttatacaataccatcatatcacacgcatgtgcacttaggttccaggcatcgacccgatccatcacgaaagctacatattacatcgctggatatcccactggataagtgggatggtgcaaaggtgtcactctatgtgccgattttgtcacgacatagttcaccgttacaattactccatgctgcttcaaagcccaagcttactatgcagccaatcgtgtaatgcagattccaatcgtacgttaccatatatctgttaactgggtgttaaaatacatactactacctg

SEQ ID NO: 7454 - DNA, 419 bp, Diabrotica virgifera
  Clone ID: LIB3026-006-Q1-E1-H6
ttgcaatgtgaacgccatgatgtgctcacacgaactgtcgcgtcaattggacggctctcttataagagcctctattctctcctgcgcatgcgggcgcccgggaatgccccgatcgaatccgaaggctacatttgcctccctggatgtctcactacgttatcccataacggcataggcaattatgtttgcggttaagttgttacgacgtttcgtgccttttcatttgatcagtcgcagtataatatacaagagaagagggaaaacacattttgatttattttgcctcgtacgttacaatacctgtgctatcattgtaaataattttaaacatacttagaagcctctatttcattttcatggcgggtcaccactattattaaattaattgtacagttagtaaaatttaggttaccgttttt

SEQ ID NO: 7455 - DNA, 438 bp, Diabrotica virgifera
  unsure (1)..(438): unsure at all n locations
  Clone ID: LIB3026-006-Q1-E1-H8
ataaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagataagaaggttgaatggcatggagacacaaccatttactgcctacaggtcaccaccgatcaagatgaatcaaaaggtgctacagctactgtaaaggaaggaggcgttggtcattcttttgtgaccgtcaaagtanagtctggtanaggacatagtttggattattacgtaaaagtttacgctaagtaataaatgtattattttttatattataaaataaaatacatg

SEQ ID NO: 7456 - DNA, 384 bp, Diabrotica virgifera
  Clone ID: LIB3026-006-Q1-E1-H9
gagaatgtctcaacagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatctaagaaaggaggacccctacattacgatgttgaaatttacgccagggcaccaaataataatattaaataatacatacattaatcgccctaaaccacttgtgaaaatatatttatataggtaataacgaaataaagatcaaatatagttaatgtataaatgatcaaa

SEQ ID NO: 7457 - DNA, 362 bp, Diabrotica virgifera
  Clone ID: LIB3026-007-Q1-E1-A3
cccacgcatccgatatatcaattcagagacaaatgagagacacgtcctagaaggagaaacacaaggttcaacaactggggaaggcaaatttagagtacatttcttaaatccagacgtaactgtacctttctgggttcttggtacagactatgaaagttattctgtaggtttgtcctgttttgaacgagatggtgctcctctagcgagccttttcatttcaacaagaactccatttccaccagaagatctggtggattcgattctccaagttcttgacgacaacaattttgctataaagccactaatcttcacagaccaaaatgaatgtacttagtagattaagataaaatacgagtatatta

SEQ ID NO: 7458 - DNA, 51 bp, Diabrotica virgifera
  Clone ID: LIB3026-007-Q1-E1-A4
aagacgcatgggaaatattacaacttattttaaatatttggtcctttcgta

SEQ ID NO: 7459 - DNA, 365 bp, Diabrotica virgifera
  Clone ID: LIB3026-007-Q1-E1-A6
acggacgcgtgggattttttaagaaataaattaaatttatttattaacaatatatttataattaaatatttttatattattaatatgaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattagttaaatttagtaatgatgataatattagtattaaaaaattgtatatttagtaaaaatatataggtttaataaaggaattcggcaacatttttttcacctgtttaataaaaa

SEQ ID NO: 7460 - DNA, 381 bp, Diabrotica virgifera
  Clone ID: LIB3026-007-Q1-E1-A7
gtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttagtgattagcctattgattagcctttagtagtatttagatatatttatgcactactattatttatttaaatgatatattttcgttgataaaataaaaaaattataatattaaaaaaatcaattttctcgtgtaattttcctaatataaaattttttaataagactatttgataatatgataaatcaagttgtatttgt

SEQ ID NO: 7461 - DNA, 100 bp, Diabrotica virgifera
  Clone ID: LIB3026-007-Q1-E1-A8
agcgacgatcttttgtgtccctcctaaagaagagcccatgttgttatatatgtttgtactgatttagaatgcatgaattaataaatacatattttcctat

SEQ ID NO: 7462 - DNA, 241 bp, Diabrotica virgifera
  Clone ID: LIB3026-007-Q1-E1-B11
gccgtagaagagtgcccaagaaaggagtcctttgatattccgacagtgattaatgtataaaattttatataatatatatattctatagagaataattccgtcttattttgcaaactatttagcaacatttttcagcaagtttccctctgggggtatactagggttccatattttattaataaattaccaatatttgttaactttaaaaattttaactgagaaaataaacctttttttattt

SEQ ID NO: 7463 - DNA, 317 bp, Diabrotica virgifera
  Clone ID: LIB3026-007-Q1-E1-B2
cttttagaattgaattatttgttctacggtcttgtccaaggaattcgtaacattcgtctccaacagaacatttcaatgttgtctatatttctttccgcagggcccccgctaccatatgtgcaaagtgtgcaatgcacacgggcgccatcctttaggggcgccaaaaccctgggtcaaaaattgcaaaaaaaacaagaaaccaaaaattaattttaaaattaaagttgagaaattaaataggattgagtataaacacatacgagattttattagtataataatataagttactgctgattcccatttgcgagaacatg

SEQ ID NO: 7464 - DNA, 175 bp, Diabrotica virgifera
  Clone ID: LIB3026-007-Q1-E1-B5
aattgatttggctccagcaggaccatcattcacaacagtaaacaccagtttccgtcatacgcccgggattgcacaagttgtcgacgttattcatacttgtggtggacatattagatattgtaccatctgatagtaaggatgattattacccaaatagtggtatgatacattaccc

SEQ ID NO: 7465 - DNA, 352 bp, Diabrotica virgifera
  Clone ID: LIB3026-007-Q1-E1-B7
gtagcaatctgtagctattacctccaaaaagtgaatggtgatgctggtatgtctgctgtttgatacaaaaaccaaactcgtatcacgagttgcctttttgtaccatccggtagcgctataatatcgatttggcttttggtcaaatcgaatcttatggtgctgtttttggtcgagctgcgaaattcttgtgtaaagactctaaattgttcgccgtattaatgaggattttctagttttatcaaaaacggttccatgttgtaaatatcgtgcaatataagtgtatgttatatattttatatatttttgtatatttttttaggaatacggtgacaaataaatgtatttttagtag

SEQ ID NO: 7466 - DNA, 148 bp, Diabrotica virgifera
  Clone ID: LIB3026-007-Q1-E1-C10
gtactttgatatatatatatgtacactgtgaacttaccatttattaatgacaatattacgtaacaataaaggacagttcacagtgtactttgatatatatatatgtacataattttccaaaaaatatattagttttgttttatttcct

SEQ ID NO: 7467 - DNA, 407 bp, Diabrotica virgifera
  Clone ID: LIB3026-007-Q1-E1-C12
atatattaaatgtatatttatctccttctagaattttgaaaatttttttttgaaattttagcaccttttaagttgtaacttgttaactattacatttattatttaataacattgttttaggttatcttttttattttgtatttgttcattgttgaacttttccccagaacttacctctcggggtaaaggcaaatacagcggttttaaccaaaagtttttttaagagttggaattacgttatgtgaaatatatattttgtagaacaaatatgcagatcaaggtctatctgtagtccttacttgattttatagaagtcgatagacaatactaaaaaacattagtgcagcgttcaaataagtaagaaaaatatattattgcatgatatcagccattttcgaaaacatata

SEQ ID NO: 7468 - DNA, 319 bp, Diabrotica virgifera
  Clone ID: LIB3026-007-Q1-E1-C6
cggacgcgtgggaagatgtagtcgcataatgaaatgcgaccagggcaacgaaacgtttaattggaccatagatattcccgatggtacaccggccgaaaaagttccagatggtaacactacctttaaagttggtcatataacggatatacattttgatcctttatatacggagggtaaagttgcagactgtcatgaacccttatgttgtcaaaatgatcaagcagatgccacaaaaggagaggatgcttgcggacattttggtacatataaacaagctgatgcgccccaagtattgcttgaagaggctttaaaccaactt

SEQ ID NO: 7469 - DNA, 335 bp, Diabrotica virgifera
  Clone ID: LIB3026-007-Q1-E1-D8
cccacgcgtccgatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataataggagtattaaaaaattgtatatttagtaaaaatatataagtttaataaaggaattcggcaacatttttttcacctgttt

SEQ ID NO: 7470 - DNA, 339 bp, Diabrotica virgifera
  Clone ID: LIB3026-007-Q1-E1-E3
caacgaggctgtctttgacgacaccacatcatggtcaaatggatttcaactctctatgaactacaatgcaaccattaaggaacttttccgttcacagcactactcaggaaccatcaagataaccatgagacaaccagtatggactggaagaatcagcgcacaaaaaacccccactgacttaaaacctaacaccactgtagacagttttaccgtcgactggcacgttgcagatgtaaaatgcaaaatcactggtatgcgattacttggagacacttatgctctcgctattcaagaaggtattgaaggtgccctcaaccatggtcttatcgggaataccgt

SEQ ID NO: 7471 - DNA, 345 bp, Diabrotica virgifera
  Clone ID: LIB3026-007-Q1-E1-E5
aaaaaaagtgccagttataattggatttaattcagaagaatggctttatctcgctttgatgaataacgaagaagtgcttaaagcttatgatgcaaatccaagttcgttagtttccggactaatgacaatgactcctgaaaatcgaaccattgcaggaaatctcttgaaagatctatacaccaataatggtagtttcgtcgatgatctaggtggttagataaggtcaacaagtgacaacctctttacaacatgaggctgtaaacaagtcgagcttgcttctgaggtggttccatattttttctatcaattttcttacaagggagagttgggaaaagggatgggatt

SEQ ID NO: 7472 - DNA, 308 bp, Diabrotica virgifera
  Clone ID: LIB3026-007-Q1-E1-E7
agcccacgcgtccgataacataatggcaaaacttacgtttgttcttctggccctagtagccatcgttgtcttatcaaccactgaggtcaactcattggtccaagaaccaggtaccctcaaagcgtccaaagcacttggtttcaagcttagtgatgatgatacctgtacatgtgccaaatgctccgattcttgtatagcactggataaagatcataacgttggtggtatttgccacttaggtgattgtttatgtgtgtatcatgaataatgttttattagttaataaataaagttttaggttttaaaaa

SEQ ID NO: 7473 - DNA, 302 bp, Diabrotica virgifera
  Clone ID: LIB3026-007-Q1-E1-E9
aacctagaggatctaggcttatcttggcgtgtatgcgacgttggatcacttctaacttgtcaggtaccttcaatttactgaccggtggttcgataacgtctgttttgggaaatctctcgtcgtgacgcaatttatgcgccttgcacatccacgcccattcgttggctggctttgcaccaatccggtccgcactgatagacccacgcaaaagttttggtcactccatggcaagtgctatgtggcctgtcacgccacatgatccattgtcaatgtagtggggatccgcagtgggatcgtttcac

SEQ ID NO: 7474 - DNA, 359 bp, Diabrotica virgifera
  Clone ID: LIB3026-007-Q1-E1-F2
cccacgcgtccgaaaccacgaaaatgattgcttttgcagtaactttttgtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcctaaatccagacgtaact

SEQ ID NO: 7475 - DNA, 431 bp, Diabrotica virgifera
  Clone ID: LIB3026-007-Q1-E1-F9
aatctgagtaggtaccaactataacaatgaaacaagttattgtctccttgtgttgtttgattatagcaactgcagctataccaattgaaagttttgtagatgaagatggccaacaatatgttttagttcctttgcagaggcagagaagggatctaacatggggagcaaaccaaaatggttactctcttggccaaaaaggtactatctacagcagtggtaatcaccaatttgacggctcgtacggtgcatcaaaagcttggggatcacatggtattaaacccgattcatttggcggccgtgtagattatactcacagtactagtggttcaaacgcctttgttggagcaaacagaactccaggttggggtactgatgtggctgccggtggaaggtacaatatagttcaaggaaagaactggaatgttggtgca

SEQ ID NO: 7476 - DNA, 348 bp, Diabrotica virgifera
  Clone ID: LIB3026-007-Q1-E1-G10
aaagaaggctgtgtattttgacgacaaaactgataaaggtgtgcctctcacccacgatttggctctagaggtgttaaatgagggtaactagtccgaaatagaagatttagatggcgaaaatgatgttgcttttgacgttcagatgtttaaaaataacactgatgacaaggatattgaagaaactgtattagatgaagaacctgtattggatgaagaacctgttccttcaaagagctcttcttcagcaaagaggcaatggaaagacatgaaatttcagcaaaaaatgtttgttctactttagttagtatgtaatagcatattaaacagttatcaaaataaaaaacaaaa

SEQ ID NO: 7477 - DNA, 273 bp, Diabrotica virgifera
  Clone ID: LIB3026-007-Q1-E1-G11
tttaatttaaaataattaaataatttttaataaaaattaaggaaaattttaattaaaggatggtaaataagaattgtaaaaaagaatttaattttaaaaaagaaaaatttaatttttggaacctggtgtaccaggaattataaattataaataaaacattaataatttccaaatttaaaaaacctaaaaatttaaaattttaatggtaaattaaaaatttaaacaaattttttggtaatgaaaggtaatccgtttttaaaaaaacctaatttt

SEQ ID NO: 7478 - DNA, 314 bp, Diabrotica virgifera
  Clone ID: LIB3026-007-Q1-E1-G2
gaaaaataaaatattgatgtgggattgaactgcaattgattgtaataaaaattacattttatacaatatatttttttgatgtttcgatatcgaattaaattatttcaacatgtagatgtgtattggcgctttgtagcagccaatttgacagctgacttgcttggcctcgatcttatagacaaaatttcaactaaaagacatggctatttacctacaagataattaagtcaagttggtaaactaatttggctgctacaaagcgttaattaataaacgtttccagattgatataattttataattttcgtgaaaat

SEQ ID NO: 7479 - DNA, 390 bp, Diabrotica virgifera
  Clone ID: LIB3026-007-Q1-E1-G9
actggatcaatcggtgttgcaagcacccatatcgaactcaataccaataaatggtatggtcttgcggattgggatatctcagctaagcaaatcaatgacgacgaagatttcgaggctgtctttgactataccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccaccgtcttaacacctaagcccattgtagacagttttaccgtcgactggcaagttgcagatgtaaaatgcaaaatcactggtatgggaataattggagacacttatgctctcgct

SEQ ID NO: 7480 - DNA, 310 bp, Diabrotica virgifera
  Clone ID: LIB3026-007-Q1-E1-H1
gacaaacataaaatcgcttaggattctgacgccaaggatggtttggaaaaagttattaagagtgaggtagcaaatgcgaaggataaagatctggaagagctgttggatatcttagatcatttctttgatcctgaaaagaaagcaattcagccaaaacctaaacctagcccccaacgttatccgtatggtcggaggccaaaattcgtgaggaacaaaaacaattcacagagcaagaacccaaaaacaaactcgactgcaaacgacaatccaaccgccagcgacgattcttctcctcgaagcgaatctgaac

SEQ ID NO: 7481 - DNA, 250 bp, Diabrotica virgifera
  Clone ID: LIB3026-007-Q1-E1-H2
aaaattgttttcttaacagtacttagtgtggtctactgcagaactattagacgtaaataaaaacatagacaaagagattctccgtcaaaataactgtgggatatattaaaacataatttaatacagcccaaaatggccaaaagggctacagtaaaacctggcttacacaacgtgattatggtatgcagtggaggagtaggcaaatcagccctaaaactccagttcatgtatgacgaattcggttaagact

SEQ ID NO: 7482 - DNA, 421 bp, Diabrotica virgifera
  Clone ID: LIB3026-007-Q1-E1-H9
agctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcgggaacaattttt

SEQ ID NO: 7483 - DNA, 328 bp, Diabrotica virgifera
  Clone ID: LIB3026-008-Q1-E1-A10
gaaacatgaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataat

SEQ ID NO: 7484 - DNA, 385 bp, Diabrotica virgifera
  unsure (1)..(385): unsure at all n locations
  Clone ID: LIB3026-008-Q1-E1-A6
atcgtgccttccttacaaatttcattttttttatacgatcgtactaaaattggtgctactatagtatgcggtctacctgtgcatgtgtatagagcctacaaacagttttctgcctttcattattgtatacaaacccttctgagaagagattatggtgttgttctgtagaccgcaagctatagcagaaacgcgacggtagaccgcataccatagtggtaccctaaaattatctcgcccgtaccacctcgatgcggaaaaggaatctcggttgtcttggcctctcgtccgttcctgtgtcnagattatattttcatacattgggaaagcgggtctaggatggctcctcggggtacacagattgttaacggaagtttttggaacggag

SEQ ID NO: 7485 - DNA, 417 bp, Diabrotica virgifera
  Clone ID: LIB3026-008-Q1-E1-A8
gtctgtagacgatttacgtacctggcagggtgttttacctaatagagcagtttccacgttgctatctatttagaatcagctctaagattaggtattcgccttttcccaaaaaaggatgtattttaatcaaactctgtttactctgattggagtacgaagggaaccattctcgttggaactttaccgcgctgagaagatgggacgagaattataaattgtaaaattccgtcatcttccttagtcttagcatccgttatggcttgaaaattgtagaagcctcggaggtgtaaccagagaaggtttccattgttttcagtctggtgggatgtggagtagcattatgctgttttatatgccattagattgaaaacttagtctgatgtaatttaagttttgctctttagtcttatctctact

SEQ ID NO: 7486 - DNA, 316 bp, Diabrotica virgifera
  Clone ID: LIB3026-008-Q1-E1-B11
ggctataccgctcttgataggttgtcatgggccgacatcattttcatttgtatctacgaaggacttatgaacatactaggaaaaaatacctttgactcgtatccaagtctacaaaaaattaagaaaaacgtcctaaatgttaaaagtattagaaattggatcaaaaacagacccgaaacaccttccaccatgggacctttgaaattcgaatatgacttaaaacaggaagtttaagtgtgattaggttatttctatacattgtaaatataaatattataaaatgattatgttttgttaaaaataaaaatatataagc

SEQ ID NO: 7487 - DNA, 190 bp, Diabrotica virgifera
  Clone ID: LIB3026-008-Q1-E1-B9
cccacacgtccggaaaaaatttactacatgcacattttatcatatttgtgcgagaataaatttaggtttataagagtcagaattaattggtgcaccttgtgtcccagggattattaagttgtcactatataattaataggttccaagttaaattcgctgaaaacttgaaatttttagtgtcaaagaaata

SEQ ID NO: 7488 - DNA, 217 bp, Diabrotica virgifera
  Clone ID: LIB3026-008-Q1-E1-D3
aaaatgtttaaactaaattctattatgagtatatacacagctgaattaatagcgataatggaagcactaaaatatttatctaatataaatcattccaagtttataagttttagtgacagttaaagtttccctagtaaaattagtgctataaatcctaaatcaaaagtgaactacattgaattataaatcataaataaaattaaagaacttcagcaac

SEQ ID NO: 7489 - DNA, 420 bp, Diabrotica virgifera
  Clone ID: LIB3026-008-Q1-E1-D8
aaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttca

SEQ ID NO: 7490 - DNA, 67 bp, Diabrotica virgifera
  Clone ID: LIB3026-008-Q1-E1-D9
ggactcgccatgtaacggtgcattaatcgcggagggcgtagcggttacgcccaacgtgaccgcgaca

SEQ ID NO: 7491 - DNA, 271 bp, Diabrotica virgifera
  Clone ID: LIB3026-008-Q1-E1-E1
cccacgcgtccgaatttaacagagctaaaaaattaaaatttttattgtaacataaatattttaactaatttttttgtaatgaaatgttactcgtttttacatataacgaattttttaagaactcaattaaatttagttagtaacaatatatttataattaaatatttttagattagtaatagtaaatatttttagggatgaccttaaacagtaaattttaataaaagttaatttttaaataaaacgtaagcataaaaattttcagatttta

SEQ ID NO: 7492 - DNA, 405 bp, Diabrotica virgifera
  Clone ID: LIB3026-008-Q1-E1-E11
cccacgcgtccgacggatatcatgatcttgataagttttttaattttaatcagaataacctttgtggcaacctaagatgtctgcaagggcaatcgtaatatttgtttttacaatatttgcaacaaatgctatatgtgctgataactcattcaagcaaaatccttggcaaaatgtgaacaattccagttataattataacactcaggacaaaaattttgtcacgccatggccagcactgggtggtccgagaaaccaacagaacaatttgcaaagtactagggctcctcagtgggttcgtccaaataatggaccgaattgggtgagaaatacttcgccaactaactctcaaggaagtaaccaaaacaataatgtaccagttcaaaattttagaccagcttcacaaaa

SEQ ID NO: 7493 - DNA, 217 bp, Diabrotica virgifera
  Clone ID: LIB3026-008-Q1-E1-E12
actgggagtatggaaattggcagcatctggagaaatcgacatcatggaaagtagaggaaaccgtcagtattatgcccccaatggacaaaacgttggaactgcaacagaatcatctactctacattggggacctactccacaattcaacaaacaactgaagactcactgggaaaagatcaatttataacgtggttgggataacgctttcatagatatc

SEQ ID NO: 7494 - DNA, 410 bp, Diabrotica virgifera
  Clone ID: LIB3026-008-Q1-E1-E8
cgacatagtatttctttatattcatacaaaactattgatcactagataaaaaaaaatgggtctaaaatcgctactttttataatttgtttgggaatctgcattggtttaagtgttgctgagaagctgaactcatcagaccaacaatatttggatgatctctttaaagatatacccgatggagatagaaaacgtgtcctttaccaccatctgtttttgggatacctgaagaagaatccacagctaaatccaactgattacaatctggatgataaggatgcagaaaagctgtacgacatatttataacaaaattcaaaacaaattctctaatgtcggatccaatctgcttctctaatggagaatgtatagatccttctgattccggcttgtatcccagctaaacgtcagata

SEQ ID NO: 7495 - DNA, 380 bp, Diabrotica virgifera
  Clone ID: LIB3026-008-Q1-E1-F4
cgtggttgttttattgagcctaatttccttggcacttgttgcttgcgatgattcagttagtacttcgacagacactccggtaatatcaacagaggtaccagcaccgatatcgacaagccttcgtgaagatagagtttacgtagacacttcaaatgttcccgacccagtctaccagatagatgccgtggaagcattcaaagaagctaaggcacttcatccagttgacggtatagctttgttaaaaacattctccgagttgtttaacgccaaacataaagtatctggaggatggaaagttgctgaaaaatatgactacttttaaaatccaaatataaactacgtgtatgttgcattgggagttatagatgccaatggggata

SEQ ID NO: 7496 - DNA, 349 bp, Diabrotica virgifera
  Clone ID: LIB3026-008-Q1-E1-F6
gtatgtattacagtctatagtatttggtttagtacatcgtaagaacgtagttaaatatttttcgtatatttttgtttctctttgtagctgatcgatttcctgctcaaaaactcggtacaccgacgattttttagactatttgtttttaactaaacggcaactcaagatttgtaatatgtgtagaagaatttttggtacaggattttttcatgtttgtgattatcgatttttttgtcatattggcgaaaacacacccagagattttcatatatggccaatatatttcaaatgtcgtttacttttataccaatatattttattagattaattaaattgatatttaatacct

SEQ ID NO: 7497 - DNA, 399 bp, Diabrotica virgifera
  Clone ID: LIB3026-008-Q1-E1-G3
aggattgaaaactacttcgtctagtcaatttagtttaaataattaataaaactgccttttaaaatataataaatatcgtccgtgtttgctacactttacttcctcattacgttcgtatttgatttagagatttttaaatgagagtttaagtcaggcaaccaagtcaataacgtcgaggaaacgtcagtgtttggttgaatatatacacgtgtttgaacattacgtcgtaaactcaccattatcacaatattaaaactttttctttgacttctcaaaaacaaaccatgtggcgcttacaacgttattcggcggacctattcaattattgtgtatttctaaaaccataaaatgaaaaataaatctaaaagcgacccaaaatcgacgtaaaactaagttttt

SEQ ID NO: 7498 - DNA, 324 bp, Diabrotica virgifera
  Clone ID: LIB3026-008-Q1-E1-G9
tgggaaaaaattaaaatttttattgctgaatagaaaatttaaataatttttttgtaatgaaatgttattcgtttttaaacatagctaattttttaagaaataccttaaatttatttattaacaatatatttacaattaaatatttctatactattaatattaaatatttttagggatgagcttaacaataaaattttattaaaatttaatttttacataaaacttaggattaaaaattttcatattttaaaatatgtgattatttatttttatatatcactatttttactttttataaattttttattaaactataaatttaaa

SEQ ID NO: 7499 - DNA, 408 bp, Diabrotica virgifera
  Clone ID: LIB3026-008-Q1-E1-H10
ttttatcttctgcaatggagaactcaatattattatactctttactgtaatccgaacataatagctatattaaaatgatgcgattaagggacaatatatacaataacaatctcgttgcgtcaaatccacatagccatgcattcagacccggagacaccgtatttcaattcaatgcggccaggttgaacagcgacacgcagtcactcgttcatcgttactaccgcccactgcggtaacggtctcggtaagacgccacgtcactactgatgcgcccacctaggcaaagtaccggattaaagaacgccgcatatttgccatccagctattgccaattcaatacgttgcaacaactgattttctcattctcctggctcgtcttaaatatgctctcgatgccctctccttcgg

SEQ ID NO: 7500 - DNA, 406 bp, Diabrotica virgifera
  Clone ID: LIB3026-008-Q1-E1-H3
aaaaagcattggatttcaatgaatagaattgcattaagttgtcttaatgggaggttacttgctaaactttcgatcctatgggttaatcttaatcttcctgtgagttattgaaatgtaatcagattaaccaaaattctgattaaattcagcacttcattaaaaagattcatatcattttgtttttttattattgaaaattttgttggttttgttgattttttaacgaattattaattattttttgtctaaggagagttcttcgagcaatggttgccggaaacaagtaccaaaaattacaaaaaccgaaccatacctacaaagttgaaaaaatccttcgggaaacatatataaaaaatataaattaacttgctagcagaaaaattattacaaatatattttatgtacg

SEQ ID NO: 7501 - DNA, 368 bp, Diabrotica virgifera
  Clone ID: LIB3026-008-Q1-E1-H9
accacgcgtccgaaaatataatataattttatcttctgcaaaggaaaaaacaatattattatactctttactgtaatccgaacataatagtaatattaaaatgatacgataaacaacacaatatatacaataacaatctcgttacgtcaaatccacatagccatgcattcagacccggagacaccgtatttcaattcaatgcggccaggttgaacagcgacacgcagtcactcgttcatcgttactaccgcccactgcggtaacggtctcggtaagacgccacgtcactactgatgcgcccacctaggcaaagtaccggatcaaagaacgccgcatatttgccatccagctattgctaattcaatacg

SEQ ID NO: 7502 - DNA, 303 bp, Diabrotica virgifera
  Clone ID: LIB3026-009-Q1-E1-A3
ccacccaggcgtccgaaaatggcaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgt

SEQ ID NO: 7503 - DNA, 312 bp, Diabrotica virgifera
  Clone ID: LIB3026-009-Q1-E1-A4
caaaaaccttacactgacgaagagctagcagaatacattagacaacacgaacagtaccaacagggaattccccaaggttaccatcctggagcttaccaagttcctccagcagggtaccaacatccacctccaggagcaggataccaacagcaacatccagccggaggttaccaacaacatccacaagcaggataccaacaacctccaccaccaggatatcaacaccaacctcgcgtagggggataccaacaacctccacaacaaggataccaacaacaccacctcaagtagaggaatccaacaacaaccaac

SEQ ID NO: 7504 - DNA, 435 bp, Diabrotica virgifera
  Clone ID: LIB3026-009-Q1-E1-A5
aaaacagttttttatcaacacaatataaaaagaggaaagagttatatcataatgttaatttaagcaatatagctgctttaatcatactaactaaagaattcatagaaataatgaataaaatggaaaaaataacgagaacttcagaagaatcaatagaccaatttctagagaaaacaagtgaattaataatatcatggctatctactaaatcaaaaagtgatgacgaaagtataaaaggaacttatataacagaagtagaaagaaatttgacagaaaatgatatattaaatagcactatttatgccatcagtacatggaatgacaatgacaatgtttattggaaattaagtcatgaagtataaagacaaagtctaaaaaagttatttttagataaagctgttatagatgttataaagaatactgtttcaagagaca

SEQ ID NO: 7505 - DNA, 393 bp, Diabrotica virgifera
  Clone ID: LIB3026-009-Q1-E1-A6
gagcttataaataaacttttattaaaatttaatttttaaataaaaattaggattaaaaattttcatattttacaacatgttactaattaattttatatatcattatttttattttttataaattttttattacaatataactttaaattaattaaatttagttctgatgataacattagtattaaaaaattgtagatttagtaaaaatctataggtttaataaaggaattccgcaacatttttttcacctgtttattaaaaacatgtcattttgtaataaatataaagtctcgcctgcccactgattaatttgaatggcccccgtatttttaccgttccaaggtagcacaaaccttagtttttttatcgaaaactcgaatgaagggtttgatc

SEQ ID NO: 7506 - DNA, 154 bp, Diabrotica virgifera
  Clone ID: LIB3026-009-Q1-E1-B1
ttccaggtccacccaggcgtccgtattaatatattttagtacgaaaggaccaaatatataaaataatttttatatttagataaatattaaaaaaaaaaaaaaaaaaaaaaaaaaaaaaaaaaaataaaaaaaaaaaaaaaacaatagataaaaa

SEQ ID NO: 7507 - DNA, 369 bp, Diabrotica virgifera
  Clone ID: LIB3026-009-Q1-E1-B12
accacgcgtccgcgcaagtattaaaagtgaagtgtgattacaattatttctagtgaaaatggattgttgtaagaaaggagaatcccgcaccattgtcaaacaatgcaaactgacaaagaaagatggtactgtagtagactgcgagtgtacctgcacatgcaaatgtgaaaatgactgcaaaggttcagcctgtcctggaaaaaatggatgcaattgtgactgtactgaagaaacagccaagttaggacctgatggcaaataccgatgcgtttgcgaatgtacatgttaattattttaatgttaattttgaattcatatctactttgtagtttgtagtaaggcgttttataaagactgtattttatttat

SEQ ID NO: 7508 - DNA, 459 bp, Diabrotica virgifera
  Clone ID: LIB3026-009-Q1-E1-B7
cagacgcgtgggcgtggaactaactgaaaaaatcgataatgaagaattaagaaaggcagttatctataggtacaactcatttaaacaagctcaagaggaaatcaccgaatacgaacctacagaacaagaacttcgcgaattgctcacaagaggagacattttactacagaaacagtctgaacaagcagcaactgataccagtgatgtcaaatgtgaccaaaatcggaaaaatgatgacgctgggatagattttccacaaattcaagaacattcgagtagtacagaagacaacgtaaaagatgaagcaacaaaccatttagaagctactgtagaagtaaagaccatctcggatacaaatgaaaatgcctatcaaatcgataaaacaaatattgaatcgtcagaaaataaaatggaagcatcagaagatatacccgaaagtattaaagaacatataacaga

SEQ ID NO: 7509 - DNA, 384 bp, Diabrotica virgifera
  Clone ID: LIB3026-009-Q1-E1-B9
ctaactgaaggcaaacaaaacttaataacatcataaaatcattgcaataaaaaactgaaaactttttgtcttccatgtttttatgtggcgcagaaggtacaaaaacgtaaatctgtaatttaaaacaattactgtttttttatacgtagttctggcaaagttttacatttgcattttagaaaaatgtgtttcatgttgtgtagtaaagccaaatttagttaactgtaaaaataaattacaaatttattttggttgtgaattggcccgaaaattttttttatatctacatttattcagttttgccaaactactaacagatacgtattttcgaatatccttttgattttaacatagagcactgattatttcaagcttctagatgtg

SEQ ID NO: 7510 - DNA, 430 bp, Diabrotica virgifera
  Clone ID: LIB3026-009-Q1-E1-C10
aaacaacaatgcttgccgctaaagttgtcttacttttgggccttgcccttttcgtctcagctggtcaagaccttgacaagggcatggaaattgtgaaatgcgcccagcgagcaataagcgtaggagtacctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatgattaaaccaaaatg

SEQ ID NO: 7511 - DNA, 429 bp, Diabrotica virgifera
  Clone ID: LIB3026-009-Q1-E1-C11
accacgcatccgcggacgcgtgggccaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatctaagaaaggaggacccctacattacgatgttgaaatttacgccagggcaccaaataataatattaaataat

SEQ ID NO: 7512 - DNA, 258 bp, Diabrotica virgifera
  Clone ID: LIB3026-009-Q1-E1-C2
caaaatggcaaaacttacactcgttctcttggcagccgtctttgtagccgttttggctacccaagaagtcagcgccggtgctgtcaaaggtgcagaagctcctcgtgctgctggacttggagcagactgcgaatgtaacgcatgcagtaaagaatgcatatccgagagctccgactacattggaggtatttgttaccaaggccaatgtgtttgtgcctcccttggctaaactaaataatgtgataaagtttaattaat

SEQ ID NO: 7513 - DNA, 376 bp, Diabrotica virgifera
  Clone ID: LIB3026-009-Q1-E1-C3
cagacgcgtgggtaattttttaagaaataaattaaatttatttattaacaatatatttataattaaatatttttatattattaatattaaatatttttacggatgagcttaaaaataaaattttattaaaatttaatttttaaataaaaattaggattaaaaattttcatattttaaaatatgttattatttaattttagatattattatttttactttttataaattttttattaaaatataaatttacattatttaaatttagtaatgatgataatattagtattaaaaaattgtaaaattatttaaaatatatacgtttaataaaggaaatcggcaacatttttttcacctgtttattaaaaacaagtccttt

SEQ ID NO: 7514 - DNA, 424 bp, Diabrotica virgifera
  Clone ID: LIB3026-009-Q1-E1-D10
atcatttagtgcatattaatccatgattcttaatgaggagcttttatagcaataatattcatttagtagtgaatatgttatatcatttcaaattaatatcataattattttaacgaaattatatggaattattaatttacaaggattaattattaaacattgatgactaaatattagtagaaaaggatattatcagggacgacatactttagtagttactattggtttacatttaggaaatattttatatgatacttcataagctataatttattatatgatattattgaggattttttcatagaatatttacatcatatatagatttaagaataatttgacctcctattagaattcatgcctttagaccattatattactcttaattaattgcataaatactataaacatcgggattaactgt

SEQ ID NO: 7515 - DNA, 384 bp, Diabrotica virgifera
  Clone ID: LIB3026-009-Q1-E1-D12
aggacgcatgggaggtagtgttaaataatttgcaaaaggaacttacaggaaactatacctgtgaggccagttggacgacatcaagcaccgtgactgctaaggattcgaaagaaatgtatgtaatggacgaattaaaaggtgatattctcctagaaggtacatctccccttcgtagtacggataagttgtttggagtatgtgttagccctgcatctcaagttaccccaaaatttacatggcttttaaatggagaacaggtttctagtgaggagtctcaaccagccaccaaaaataataaagatccgaaccgttttatcgcttacctaaaatggacgaatggagtttcgttcgtagatggtaaggccaacctaacttgtgttgttg

SEQ ID NO: 7516 - DNA, 387 bp, Diabrotica virgifera
  Clone ID: LIB3026-009-Q1-E1-D4
catcatttaaagtgaaaacttaatggtgaacgaatctaaataaaagttatagaattttatgcatcgagcgtactttgctacataaggaattgaagaagaaaagtgctaaagcataatgccttatcgggctggagtgcgtattatctaaaaaagattatgagtcgtacgagaaataatatgacaatcaagataccgagatggaattatctttaatccttgggatagtctatatcatactacctcattttacgtcagctgcaagcaatttttcaacagagcaaataaatagtatagaagatacaacccagactcctttgaaagcatacttaactaatggagagatcattttacttccaaaaacagaatttccaccgaaaaatgaaatat

SEQ ID NO: 7517 - DNA, 443 bp, Diabrotica virgifera
  Clone ID: LIB3026-009-Q1-E1-E6
gaagaatcagcgcacaaaaagtccccactgtcttaacacctaagcccattgtagacagttttaccgtcgactggcacgttgcagatataaaatgcaaaatcactggtatgggaataattggagacacctatgctctcgctattcaagaaggtattgaaacagccctcaaccatggtcttatcggaaatgccgtctgagacttccttaaaatgagattcaacactgtctggtatcacactggcaaaatctggcaaatgatggactggtgcaacggcggctccaccgacgccccaacaacagctgcaccatacacacatgcaccctcaacagctgcaccatacacagatgcaccctcaatagcctgcacctcaacagctggaacctcaacagcagcaccctcaacagctgcaccatacatagattcaccctcactagctgcaccc

SEQ ID NO: 7518 - DNA, 314 bp, Diabrotica virgifera
  Clone ID: LIB3026-009-Q1-E1-E8
tcaaaatgttactttggttagtagtattcctgttaatacaattcatttatggcttcattgtgtataatgtgcgatacaacttcatctttaaatcatgttcaatcatttttcgtaccatgggtctcaaggattacaatgttgagactctctaaatcatgattttggattataaaagacctaactgtattcaaatttttactgtaaactaaatcccttatgatatcttttttgtcatgagatgtcatgcgtcattagcccaacctaacttttttccacatccttcaaattcagtcaggaacgctgtgtttgtgatt

SEQ ID NO: 7519 - DNA, 361 bp, Diabrotica virgifera
  unsure (1)..(361): unsure at all n locations
  Clone ID: LIB3026-009-Q1-E1-F1
cggacgcgtgggatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagttattctgtaggtttgtcctgtttttgacgagatggtgctcctctagcgagccttttcatttcaacangaactcaattccaccaaaag

SEQ ID NO: 7520 - DNA, 470 bp, Diabrotica virgifera
  Clone ID: LIB3026-009-Q1-E1-F3
ccacgcgtccgcaagatgaaactaatactttttggtattgttgtattgttatattttatatactgtactgaagagggtagtgcactaaactgctatcagtgccaagcgaaggttggaaatgggtctgactgcgaaagtgggaaaagtgattctaatactacttgccagtcttctccagacagcaatgagacacttgcttgtttctctatagtagtaaatggcttttttataagaggttgcgacaaaactactttatgcaatgatgaaccaccacctggatatgatataaaatggtgtaaaagttgtactactgacttatgtaacactcacacttcttcttcctctattattacaccagctttattcactccaatcattatttttaccgctgtactaagttacttttaattataatttttaagcatatttgtacaattttttgagtcaaagattaaaacatttttttttgt

SEQ ID NO: 7521 - DNA, 380 bp, Diabrotica virgifera
  Clone ID: LIB3026-009-Q1-E1-F7
gggatttttcggttgacgtttgagaggtccacctgtcttctttgacatcttgtcatgaattttcgggcaccaatctgtctggtcggttggttgttgacctctcacctggtcgcagccttgtgctggttccgagcggggatgacatgcatccgcatgtgatgcatttttgatcttgatacatcgacttgttgtcgattgctatgcggctcgtagtgtggcaatagtgttgttttgaggttttgcacctgttcgagtggctggtttcagttgcttgtgcactggacgtgggtagccacattttctttttttagctgtcagaatttcacccttttgcatttctgtctgggttggttcacttagtttccaggtttgcactgggg

SEQ ID NO: 7522 - DNA, 306 bp, Diabrotica virgifera
  Clone ID: LIB3026-009-Q1-E1-F9
aaactttatgacacagaagcttatcatgttgctagggtcggttgggaatatgaaggaatggaatttaattcgactacatatcttggaactgtcaattttaacgatcaaccaaatataggaaaaatttttaatgctgcagttctttgggcagaaaaccacgttttatatttcccttcacagggaacagttttgagcggatactcatattatgctttggtttattattattaagtgtattttaagtaaaatgaaatatttagtgtattataaatgcataatttaatatacaataaaaaaatataccat

SEQ ID NO: 7523 - DNA, 177 bp, Diabrotica virgifera
  Clone ID: LIB3026-009-Q1-E1-G7
gcctgtcgtaaggtcgtattgtccggggcgccccacgcgtccgaaatatcattgttttttaagagtatttaggatattttaagtttttttttgagagtgtttcgcaaacttaactgagataagtttccggaacatgatgtgatttttttaattataataaagcgcatttttcttgtt

SEQ ID NO: 7524 - DNA, 374 bp, Diabrotica virgifera
  Clone ID: LIB3026-009-Q1-E1-H5
gacttttataaagtcaaatacttgggccccaagcaggctgtgaaaagaagcgataacggaatttgtatgccacttcttgatgaagaaaaagaaaaatcgaacggcgtaacaaaatccagtagcaacggaaccgtcaacaacggctacatcaaaagtgaattctcggaatcgtacgaaggttacgcgaacggtagcacaaagggattcgtcacacaatctataaccaaaccaaacaacaccaagaagatagagtagataagatcaattgttttttgtttttaattttacctaggtttaatatttatatttatatcgattacatcaaatgatttgtaacaagacctggaatttgctactgaataaaattaatttat

SEQ ID NO: 7525 - DNA, 89 bp, Diabrotica virgifera
  Clone ID: LIB3026-009-Q1-E1-H8
gtagtaatagtgtacacatttttaagaataaacatgtttaataaaaaaaaaaaaaaaaaaaaagtttaaaaaaaagaaatcagaaaaag

SEQ ID NO: 7526 - DNA, 421 bp, Diabrotica virgifera
  Clone ID: LIB3026-010-Q1-E1-A10
cccacgcgtccgcccacgcgtccgaatttatacatgattacatacattatttaaataattaaattcattccgataattattagtttatcatattgtgcctcatttaatgttcattgagctatcatctatatgatttgggagcctttttatatgtacagtaaaacctaccatatccggatcaatgtggcgacagaccgatccgaatatgaaaaaatccggatatcaagaccactacttcttttagtctctgaaacgttttctcctttacacattccagtaatcaacgccgtcaataactttcgtcgatagacaagttttatagattctataatacattatttcgccatcttttagttcttcttttagtgcgttgtccatcagcaggactgcctttctcggtagatttcggtagatccggacg

SEQ ID NO: 7527 - DNA, 429 bp, Diabrotica virgifera
  unsure (1)..(429): unsure at all n locations
  Clone ID: LIB3026-010-Q1-E1-A11
aacactaccgactggagagcgattggtgaactccattggttcgctggtgtgtgtgtgtcggactatgtagacgcacctcgtacatggacttcagtggcgtgacttcagtgacgaaacgggcgtcattgtactgtacgtttttaacaaccattccaaaatttgtaggcctttctggcacaaaagtaggaaacaattctgacaagacaaaatagtatttttaaacaagaccttaaatagagaaaacaatattaatatcaatgtacaaatattataattaatatttaatcttaggtaattatttataaatacttttgccaaaaaattaatactaaaaaaataccgcaaaaatactaatcgttttttgtagggaactttgtatatttattctgtcttaagatgaccaaactatcanaaacagattgtatttac

SEQ ID NO: 7528 - DNA, 302 bp, Diabrotica virgifera
  Clone ID: LIB3026-010-Q1-E1-A2
cccacccgtccgaaaactcaaaaagaagctggtcgacctgatttgtcgatcttgttgaataagtagatacaggacaggagtatgtacgctagatttatggaaataggtaatactatttctaaagatcaagcagtagtacatggtgattgtcacaacgggaatatgatgtttcaatacagggatgacgataaatctgttccacttcgcatggttttgatagatttccgagcgtcgtttagtcattcaccagtaggcgatctctcctattttcgatggatgaatttatcaccaactgaagctcc

SEQ ID NO: 7529 - DNA, 287 bp, Diabrotica virgifera
  Clone ID: LIB3026-010-Q1-E1-A3
catccaaacttcctatacactaactttttctttgctggtaatatctgcacatggacaagttcctgttgcaaggtgtccataggtagaagtagttacaaatttcaatggaagtgcatatttgggtgactggtacgaacagggcagcaacccaagtttactgggagatcactggagatgtgttgttaccaatattgcactaggtgacgatagaactataaggaatccggcgcaatatatcaagtcagcgacaaatgacagacacgtcctagaaggagaagcacaaggtt

SEQ ID NO: 7530 - DNA, 415 bp, Diabrotica virgifera
  Clone ID: LIB3026-010-Q1-E1-B12
tgagatttaagtcaatgttatgagtttatgtgcaaaggtactacgacaagcagaaagaagatagacgtcactgaaatggtctgttgtagaagaatgtttcgaattctgtgaggcgaccacaggacaaataaatgttaaatgagtaaaaaatagttcaagtattaccaagactgccctagagtgaaatccccaggaaaaagaaaaagatgtcacccagctaaacttagagaagatccatcatggacgagataagaagtcaaggaaagtcttggagtgagatgaaggcctaagcgcgaaataaaacccgatggcgcattttcactgaagcttcggagttcaagatcattatgagtcaaaggtcagcaaatggctctcaagcaaagttcatctccggcaattaaaatactttggacat

SEQ ID NO: 7531 - DNA, 242 bp, Diabrotica virgifera
  Clone ID: LIB3026-010-Q1-E1-B3
aacaaataaattaaatttacttatgaacaagatatttataattaaatatttttataggattaatatgaaatatttttagggatgagcttaaaaataaaattttattacgatttaagttttaaatgagaattaggagtaaaaattttcatagcgtagaagatgttattatttatttttatatattattatttttattttttataaattttttacgaaaatataaatttagattatttaaattt

SEQ ID NO: 7532 - DNA, 317 bp, Diabrotica virgifera
  unsure (1)..(317): unsure at all n locations
  Clone ID: LIB3026-010-Q1-E1-B4
catcttcgttgatgtgaaaaaaattcgatgttccgcaagatcncgcttaagaattctataggtagatattaaatcatctcgctctcttctacgagtcaatggagacaacttaagctttctgaatcgagtttcagagcttaatcttgcataagtaaaaggtagcttagtagctcttcgttgtactccttctaataaattaatatctcgtggtaaatgaggtgaccaggcaggtattaggcgttttaataagtccgacacgtagaacatttgagatggcaggaattaggttgatgataaagagcagtctggatttttgc

SEQ ID NO: 7533 - DNA, 375 bp, Diabrotica virgifera
  Clone ID: LIB3026-010-Q1-E1-B6
aaaacctagaagtaactgcaaagtataaaaatgaggcaaatacttactctttcaattcggtgcgtacttgcagtccattttgtaagttccgttagtctccaaaagggtacacttgatatcatagagggcaattgcaccagtccaaatccaaaacaggcactattgaaagattatgtccacaagactagcattccttttgtcaaaagagaggaaacagttgaatggcacggtgatcaggaaatttactgcgtaacagccatcagtcttaagagcgccgaaaaaggttcaactgcttggatctcacatggtggagttaaccacacctacatcgcaatcgaactggaatctggtagagggcatggcttggaatacaac

SEQ ID NO: 7534 - DNA, 368 bp, Diabrotica virgifera
  Clone ID: LIB3026-010-Q1-E1-B8
gtttataaaaccacgaaaatgattggttttgcactaactatttctttgcttgtaatagctgtacagggacaaattcctgttgaaagatgcccagatgtaaaaggagttgcaaatttcgatggaaaagcatatttgggtgactggttcgaacaagcaagagacccaactttactggaagatcacggaagatgtgttgttaccaatattgcagtaaacgcaaatggatctgtaaagagtcgtacgcaatacatcaattccgaaacaaatgagacacatgttcgcgaaggggaaggaatagcaaattcaaccacaggagaagccacatttttagtacattttcgtaatccagacgtaactgtaccgttttg

SEQ ID NO: 7535 - DNA, 276 bp, Diabrotica virgifera
  Clone ID: LIB3026-010-Q1-E1-C3
atcaccttatagctattttggccgcgctcagaggaagaaatggtgccctcttaaatatacgatcccgcgattgagcgattgttttggaaactgcattagacaagtttacatctcatagggttgaactgtacgcacggtaactagcattttcaattgcaagtgcgcgatgagaatgaatcactaatactaagttctataaagaatatctgtatgtgtactggcgatctcattatcatactcatgttaggtttggcgttcaccttatgatgaatgacc

SEQ ID NO: 7536 - DNA, 359 bp, Diabrotica virgifera
  Clone ID: LIB3026-010-Q1-E1-C5
accacgcgtccggaaattgtgacagtatcgtgaattattccaacatggaaccgttagcaataataattcctgtatattcagtagttttgttaatgctccttttacagattcgatgggcgtttaaaatcaagaaaaaattgtacaaaatgatcgatgaaggttactactttttggagttggaaacaggctggggaaggaaaattttgaaacctagttcctccaggcaacgtagatttatcatccggctctccgatactgatcagcaacatcagaattcgccaatgatatcgccgaaaatgttaacgaattttggaaatcatggaaattgttaatacttaagtaaatacaaaaaacttttg

SEQ ID NO: 7537 - DNA, 113 bp, Diabrotica virgifera
  Clone ID: LIB3026-010-Q1-E1-D1
attcacaaaacctaaaatattcatgcaaacacttactcatgggtgattattgaatttaaatgttcgtacatctcaggtacgaaccagaatttatgaaaagaattgattaagca

SEQ ID NO: 7538 - DNA, 375 bp, Diabrotica virgifera
  Clone ID: LIB3026-010-Q1-E1-D2
acagttttaacaaacgtcttcgaatgcatttccaaagtgagttagtcacataaggtctgataacgtaataaatttatggggaattcagtttgtcaaactgaacacaccaaaaacatcgggtttgtgtattagatgtgagttttatacgatccatattattgtgtgttgagaaaagttatgaaaaattaaaattagcaaaaatagtaattaaagcatgtcgccacacttaaaattacatcttccagcttcgcacgcccttatttcgtatatgttttcgcagagatacgtctaacatagctcgttcgatgggcctctgtgttggtcgtaatctgttaacggataactctgtaagtgtcacggtctccattcggtagt

SEQ ID NO: 7539 - DNA, 322 bp, Diabrotica virgifera
  Clone ID: LIB3026-010-Q1-E1-D6
accacgcgtccgggcgatcatacctatgaagtccacagggaccaagacatcgaccggctgattcatattgacgacatcagacctgcaacagccctagaaatcaacggcgaccaagccgttaacgaggacgatgaagcagtgttttgaccccaagaaggacattttttttcttttcccacaaagatattttcaaagacattttttttctttagctttaggtttttcgaattgtaaaaccgtgttttattttcaataagatttttttttgcacacaggaaggtctccagagcggaggggctgtcaccaatggcggcgttcgtta

SEQ ID NO: 7540 - DNA, 421 bp, Diabrotica virgifera
  Clone ID: LIB3026-010-Q1-E1-E10
aaacccacgaatatgattgctgttgcagtaactttttgtttgctggtactatctgcacagggacaaattccggttcagagatgtccagatgttaacggagttgcagatttcgacggacgtgcatatttgggtgacgggtaccaacaaggtacatatccaccatcactggaagatcacggaagatcgtgttgtgaccaatattgcagtaagcaccgatggatgtatgaggagtcgtacgcgatatatcagttcagacacaaatcagacacacgttcgagaacgagaagcacaacaatgttcatcacctggggactgtcgatttctagtacatttctcaactccagacttacctgtacctttccaggttcttggcacagactactaaacttactctgtacgttacgtccgttttgaacgtaat

SEQ ID NO: 7541 - DNA, 376 bp, Diabrotica virgifera
  Clone ID: LIB3026-010-Q1-E1-E2
aaagttcaaacttgccacaaataaattacccaggagtttaccaagtaccagagagctgctgcagaaatagcaaatgccaaagtatcgcttctctttacatgagaggttgcttaccgaaaatccactatataagcgcgcaaagtgctcttctgcttggagttggggctatgtgcataacattcaatcagcttctcggtgctacatttgcccatcgtctggccaaatctattagaaaacttaggacacagattgaagtggtaagatcactaagaagacagcaactgtacgagtcgcttgcgaaatctagcacacatgagaaagttagtccagtcctatacgtggcagagtcgtcggaagcttacgaattcgtcgtgtg

SEQ ID NO: 7542 - DNA, 188 bp, Diabrotica virgifera
  Clone ID: LIB3026-010-Q1-E1-E3
aacatgcatccgattttttagaatactatcaaatagacctttttgatctactctacgacttaactagtatccaacttattttggtacatttcataaaaaattttttgatatacgatgatttcaccattatccacgttcaggtgtaccaaaccaattaaccaatcccacatttttacagttattttctc

SEQ ID NO: 7543 - DNA, 331 bp, Diabrotica virgifera
  Clone ID: LIB3026-010-Q1-E1-E5
actcgccgtcccacatactggccaacgggcacaacttggtggccaagagaaagatcgagacgatccgagagcagcacttatacgccttggtccactactcgccgtcccaccgactggccaacgggcacaacttggtggccagcagaaagatcgacacgatccgagagcagcacttataggccttggtccactactcgccgtcccacatactggccagcgggcacaacttggtggcgaacagaaagatcgacacgatccgatagcagcacttagaggccttggtccactactcgccgtcccagcgactgcccaaggggcaccacttggtggc

SEQ ID NO: 7544 - DNA, 424 bp, Diabrotica virgifera
  Clone ID: LIB3026-010-Q1-E1-F12
agacgtatttggattttacgtaattgatagtcaaccaaataccctattgggatgggttgttggcaaaatggcggcagaagtagaatatatgagtgacgatgatgttattgctttgtgtatgttcctactgcggaagtttttgggtaaactttataatatctgcgatgcagatgaaattttaaggtcaaaatggagcagtaattctcatttttgtggttcttatgtcttcaaaagtatagatcaagaaaaacacattgcaacggctgaagatttagctagaccagttacctccaacaaggataataaacctgttttattttttgctggataagctacaagtccagaccacttctcaaccgtccatggagctattgaaacaggtttcagagaaggagatcgattagcgcaactattaaagaagaca

SEQ ID NO: 7545 - DNA, 276 bp, Diabrotica virgifera
  Clone ID: LIB3026-010-Q1-E1-F2
gtccacccgcccgtccgaacagcatgaagatcgctatcgttgtttcagcccttgtggcacttgcactatctacccctttagaacaaagcccagaaattaaatttattgagaaaggcattactggagagggaacaactactcgttagtgggactgttgcaaaccttcctgctcatggaggggacatgtccatacacctagcggagtaccggttgcgtcatgctatagatctggactggacagggttgatgataatgcggaatcaggatgtgaaggtg

SEQ ID NO: 7546 - DNA, 377 bp, Diabrotica virgifera
  Clone ID: LIB3026-010-Q1-E1-H1
tccgaaaattaaaactttcagctctgggccaatagcagatattggtctcatgtgccagttttagacagtcattggaaaattgttgaaacgtgaacacggtagtcgtgtcggcggtacctgagtaaaaacagtgaagacgcgagtcgtgtcgccggacttgaaagtgttaagacctgaaataattttgcttttccatttaacagtttttctatcagtgttagatatgaatacatttacaatttgggacatactcgtatcatatttttttactacgacggaagagttttgtagtcagctaaatgtgtcgagaacactagtaacactacgggattttcaggtgtggtaagtttaagttacaattgattatagagtgttgt

SEQ ID NO: 7547 - DNA, 418 bp, Diabrotica virgifera
  Clone ID: LIB3026-010-Q1-E1-H10
atccttataaaaactcaataaatattctttaagctagtattcggaatgttttgtatattgtgattgtataattttagtagttatggttttgtagtccccttagagtttcttttttaagagaagttcaattataattgtgcataatttatttataatttaggcattgttgatccaatataaatatcttgttttataaaaacaatcctttagtcaaaaaaaaagaaaaaaattgaatggaacagtgatcaaaaaaattactgcataagaaccaatcaaatcttaagagcgccgaaaaaagttcaactgcttggatctcatatggtggagttaaccacacctacatcgcaatcgaactggaatctggtaaagggcatggcttggaatacaacgtcagcatttatgctaaataatgttactg

SEQ ID NO: 7548 - DNA, 332 bp, Diabrotica virgifera
  Clone ID: LIB3026-010-Q1-E1-H4
atgggcccccacaactttaaccaaaaaaaaggaatgcgtcgtttcagcaaaagtttccaatttaaaacgtgaaactaaaacttcggttcggaattttccgcttaggataagccattcgaaagatcgggaaaaatatagctgtaagacgggttccgtcgggagtatttggggtccataaagttatttatggggttattggcatgtagttaaactttgatacgaccgatcctcattgacttttatctgcctcagtcttttttgagctacgcctttttgagatattagtgaactagagacgtcacatgtcgtatccgtcctttctttacccggga

SEQ ID NO: 7549 - DNA, 269 bp, Diabrotica virgifera
  Clone ID: LIB3026-010-Q1-E1-H6
cccacgcgtccgatttagtttacaagaatagactcttttttagtacgagtaaggaacaggtttatttagtgatagttaactagtattgtgagagactactttacttttacaagcgagcgatttatttggcgtaccttgtgtcgcacggattatcacctagcgcgtagagatttactagtttccaatttaaaccagctaaacaattgagatttttagtgggcaataaatattttacagaacttttttgtaatgaactgttattcgttttt

SEQ ID NO: 7550 - DNA, 278 bp, Diabrotica virgifera
  unsure (1)..(278): unsure at all n locations
  Clone ID: LIB3026-010-Q1-E1-H8
aaaagacatccaggtgaataccgtggtggtggagaatacgtggttccanacggtttcggttgggccaatggggaaacgcttacgttaaataacgaattttacgcaaaatcacacaagaaacaccataaacacgggaaatcacatcacagacatgagaaacagggaaataacgatgtatgaatgtttttaattaataatttgttttaatacaatgtaagagaagggtaacgttaattgggtttagatttaatttaatccaataaccgaagtaaataaca

SEQ ID NO: 7551 - DNA, 423 bp, Diabrotica virgifera
  Clone ID: LIB3026-010-Q1-E1-H9
accacgcgtccgcccacgcgtccggtaactgcaaagtataaaaatgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgt

SEQ ID NO: 7552 - DNA, 466 bp, Diabrotica virgifera
  Clone ID: LIB3026-011-Q1-E1-B4
ggcgacccaagccttcggaaaaaattggccataatttccaaaaggaaaacctccgtaattttttaaccgggttaaattaagttcacaatttcggcctcctgggaattggtaagttgggggtaaaaaaaattgaaccaaatttgacttttaaaataaatccacaacgactttaacaactttgtatataccgcagaaatataggttagttatgctcttttgtgtaatatatggaataataatagattaaaatatttttaaaattaaaaggattctattctgtatctaatttttgtataaattttgtaacttttcagatttcaatgattctaaatttctggatatcttcttaaacactgataacgatacagcgaaactactagacatattctaaagaaatcgaaaaaaaaatgttaacgacaccgaagttgatgttaaaaaaaaagttacaaaattattagatttaata

SEQ ID NO: 7553 - DNA, 349 bp, Diabrotica virgifera
  Clone ID: LIB3026-011-Q1-E1-B6
atagtagaatggtgaaactattattatacaagttcagtattgaaaaaaataaaattttttgtaaagaaatgtaaatcgatgttttaaatataactaagtgttttaagaaataaattaaatttagtttattaagaatatatttaggagggggctattttggtttgattaatatgaagtatttttagggatgagcttacctgtaagattttaatagaatttaatttttaggtagtaattttgattaaaaatttgcagaatttaccagatgttattacgtatatttatatagcagtaattcgatttttgataacttgtttatgggcatagggagttacattgtttacgttta

SEQ ID NO: 7554 - DNA, 407 bp, Diabrotica virgifera
  Clone ID: LIB3026-011-Q1-E1-C2
agagggtagcgcactaaactgctatgggtgccatgcaaaggttggaaatggatctagctgcgaaaccgggaagaatataagttctactttgagtcatacctgcacaactccacaagacagaaccaagacactcgcttgcataacgcttttaacaaatacaactatctataggtattgcggatacaacaatacatgcaatctgaatgagacaatcaaaacaactggatttaaatggtgtaaaagttgtactaccaacttatgtaacactcagtcttcttctgtctctattattgcaccaactatattaactccaatgattattgttacagtagtactaagttacttttaattatacattttaaaagagagttgtagacgtttttatattattaaaatatttttttagt

SEQ ID NO: 7555 - DNA, 462 bp, Diabrotica virgifera
  Clone ID: LIB3026-011-Q1-E1-D11
gtccgcccacgcgaccgggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgtcgtcgctttggttaacactggcgcacctttgctcaaagatctaactgaaatccataagcaagcaagagacgccgccgaagaaattgacaattgtgaaggagataatgcagctggtttgctctgcgtttttcaggtcgccatggatattctcaaagttgaccttcagattcccgatgctgtg

SEQ ID NO: 7556 - DNA, 174 bp, Diabrotica virgifera
  Clone ID: LIB3026-011-Q1-E1-D3
aggcctccgcgacagcgtacgcccatgcgtccggtttgatccgtttcactaattcactctgaatgattttctagttctggcagcagtttttgcagttgctgacgcattccaagttgattatctccgttgggtcagcttatacggaactctgcctgacaacggattaccacctgg

SEQ ID NO: 7557 - DNA, 55 bp, Diabrotica virgifera
  Clone ID: LIB3026-011-Q1-E1-D8
aaaattcataaaatatgtcttaaacaatgaaaacaaaaaaaacataaaaaataat

SEQ ID NO: 7558 - DNA, 390 bp, Diabrotica virgifera
  Clone ID: LIB3026-011-Q1-E1-D9
catcaagatgattggttttgcagtagcaatttctttgcttgtaatatctgtacaaggacaaattcctgttgaaaaatgcccagatagtgaacgagttgcaaatttctatggaaaaacatatttgggtgactggtcctaacaagcaaaacacccaaccttactggaagatcactgaacatgtgttgtgacaatattgcactcaactcaaatggatctgtaaagagtcttacacattacaacaattcccaaataaatgagacacatgttctcaaaggggaacgaatatctcattcacccacaggagaatccacatttttagtacattttcttactccagacgtaactgtagctttttggactcttggtacagactatcatagatggtctgta

SEQ ID NO: 7559 - DNA, 358 bp, Diabrotica virgifera
  Clone ID: LIB3026-011-Q1-E1-E12
cccacgcgaccgtaaatatatatgtattatttattactttatttgttacctaatacaacataaactatacgagggttgatccaattatgtaccaaataaagtaataaatatatatgtattatttaaaaatgactaaaagtacaaacattgaagctaataatttataaagtttttatactatatttttaaattgctgattaaaattacgataatcatacgaatcaagcaagtatgaaaattttccagtgtttgtatgattcatacatctcaggctgtgatataatattgaaaatattgttaattttttattataacagtgaaaaatgatgtacttacttaataaaaattatttaagtag

SEQ ID NO: 7560 - DNA, 102 bp, Diabrotica virgifera
  Clone ID: LIB3026-011-Q1-E1-E5
ttccgggggcccccacgcgtccgccatcgcgtccgctttttttttttttttttttttttttttaatatttatctaaatataaaaattattttacagcatttg

SEQ ID NO: 7561 - DNA, 174 bp, Diabrotica virgifera
  Clone ID: LIB3026-011-Q1-E1-F12
ccacgcgtccgaaaaattgtgcaaagttttaccaggagatttggaaaaattgtgcgaggacaagttaattccagcaatcgaccaaatgtacaaccagatggaagacactcctcctagagatttatgcgtagagttggaattctgtaattaatttgtttgttagaatattataat

SEQ ID NO: 7562 - DNA, 454 bp, Diabrotica virgifera
  Clone ID: LIB3026-011-Q1-E1-G10
atttattttaaaataataaaatattttttagtaaaagtaaagaaaaattttatttaatgatagttaattagtaatgtgagagaataatttaattttaaaaaagaaaaatttaatttttggaccttggggttacaaggaataataattaataaataaaaaattaataatttccaaatttaaaaaacctaaaaaattaaaattttaattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttattttt

SEQ ID NO: 7563 - DNA, 436 bp, Diabrotica virgifera
  Clone ID: LIB3026-011-Q1-E1-G11
ccaacgcgtccgcgattttttataagttgagaaatttttttactaattaagctagtttttatctattctgcgatatttttgctttattcttatttgagaattgttcacattatatttttcattagttctttacgtttattaaaataacttaattaaatgtgatatgatattctacttcatttcagatatatgtatttatattttatattctctttttataaacatgtaataatccttttgtttatttccggttgtgtttgcaagacatccatgtgtattttttgttttttatattcctttagtttatataagtatacctacaagtttaagcttcattcttgttgtattatttgacaaaaaattacttgcctcttgcgtgtttggtaaattataagtttataatttagaaaagttacttaaaagaattagattttgc

SEQ ID NO: 7564 - DNA, 401 bp, Diabrotica virgifera
  Clone ID: LIB3026-011-Q1-E1-G3
cccacgcgtccggaacacggtagtcgtgtcggcggtacctgattaaaaacagtgaacacgcgagtcgtgtcgccggacttgaaagtgttaagacctgaaataattttgcttttccatttaacagtttttctatcagtgttagatgtcaatacatttacaatttgggacatactcgtatcatatttttttactacgactgaatagttttgtattcatctaaatgtgtcgagaacactagtaacactacgggattttcatgtgtggtaattttaagttacaattgattatatattgttgtaaaaaccttcaattcaaaacaacattttcgagtagttaaacgtgtatgatacacacatttcttcaataaaatgttttgttgtaacaaaaaaaaacaaaacaaa

SEQ ID NO: 7565 - DNA, 367 bp, Diabrotica virgifera
  Clone ID: LIB3026-011-Q1-E1-G4
tccggggccgtcaggcaactaaaagatctgcagctcatagaaaagcaagatgagctgagaacacaagcgaaacgggccgtgaatgaaaaactatccaaagaaaaggaactgctcaaaactaaacgagattttaaagaagacaagactgtaccagaacctgttggtgaaagagacccaagtacagagtgtgccattcaacattgtaatgagagttgtcgagacaatagtaaattaataggaaaattacagaaggaaaactcagagctaagtaggaagaaccaaaattgtttagaggaaataaacgactggaaaaataaatataacaaactgttgttagacttttccatgttccacactaaaataagtt

SEQ ID NO: 7566 - DNA, 457 bp, Diabrotica virgifera
  Clone ID: LIB3026-011-Q1-E1-G7
ccaacgcgtccgcccacgcgtccgcaatgttccacaattgatggtaaaattattaatatctccgattttcagagtatggatgagtttaaaaatggatgtaacgctacagaggaagaaacactacaaaggaagcaaacaattggtgtaggaagtttgtccagagaagagaaaacaaactccagcgaatcgtccgaaacaaactcgacaaaaaatcgaacggtgcgtgttgtacaagaagaaaacgtaatagttattaaagagaatgacagtaaccttatatttggtgtttccttaaccactatcctagtatcagtattaagctttttgtctggcttacttttggggttttttcttaatcattttataaggcgaagacagaacttagaagagtctgaaagtaccacaaaacttattataggaaataaagtgccacattagacttttacaataagaaaaa

SEQ ID NO: 7567 - DNA, 401 bp, Diabrotica virgifera
  Clone ID: LIB3026-011-Q1-E1-G9
gtaactgcaaagtataaaaatgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttaatgcaaataatgttaatgaggttttt

SEQ ID NO: 7568 - DNA, 436 bp, Diabrotica virgifera
  Clone ID: LIB3026-011-Q1-E1-H1
ccggtgatgttgattatagttactttcgagtattcgttacaaattattacttttgtataaagaaatcatttacagtattcgttactttgattactatgattacttttgtatttgagtaccggtaatcatatcgagaatcgtatttctcagtaggtaggtattttgtataggtattccgatataataacgaccttcacgaagtacgaagtaatcagagtaatcaaagtaatcaaagtagatacaatagtcgttactagctatgatacgattgatacgaagtaacgacgtaatcagagtaatcaaagtaacgatttgcctctctgtatagtaatcgttactttcggtattcgtaagtaatgagtactttgtaacgaatagttactttttcaacatcactagtcattagaccaataatgacatacgcagccgaaacacg

SEQ ID NO: 7569 - DNA, 392 bp, Diabrotica virgifera
  Clone ID: LIB3026-011-Q1-E1-H12
tccgccaacgcgtacgcccacgcgtccgaaaaaaattaaaaaaaaataaattttaattttaaattacaaaactttattttttttacaagaagacactaccctagttttatttaattattaatttctttttttattaaaaaaataggtttacctcccaaatggatttaatctaagttgcgtgataatgaaatttaataacctttctaaaggttaccctaattcaaattaattggctgccttttaaaattttgatacagggaaaacccctggtttaccccaatttaatccctttgaagaaaatccccttttcccaataggggttaataccaaaagggccccaaactttcccccttccaaaaattttccaaccttaaatgggaattggaaccccc

SEQ ID NO: 7570 - DNA, 305 bp, Diabrotica virgifera
  unsure (1)..(305): unsure at all n locations
  Clone ID: LIB3026-011-Q1-E1-H2
agatgatgatgaccgcgtatccgcagaaatttttcgtgcaatagtttccaaagctataaatgctatttggattgcgaaccttcgaaaggtgacggcgcaataagaagaagaaagaagttaacacaatactattgttaattacgaataagtttacatgaagcaataagtatattcgctgaagtgatgctgaattaaacatactttgaatgtctatacatatgaaacacagaacaagtcgagaagttatttttactgttgaatgctaaattgtccacgtnattacttctcatgctcatgcgaatatg

SEQ ID NO: 7571 - DNA, 444 bp, Diabrotica virgifera
  Clone ID: LIB3026-011-Q1-E1-H3
cccacgcgtacgccattctaatatagtaggttgttttgtataaataagttgagtatgcatttaattatgacaaaatgtcatattgacattttagactagaaatataccagaaatatactaaattattttataattttgatttaatttagtttatacatatcattttaaactttagacattttatgtaaccaaagcaaaacagcatctaatgacacatccgataagatgtatgaatgagaatattttgaattttgtttaaattacaaatcatagttgatggattaacaagttgtttatatttttattcgtaataactaaatactgtaattgccttttaccatcttaggactctaaactgtcacctagagagtacatgctaactttttttagtcaaatattgaacaaatgttttgcttttcagagatctattgatatggataaata

SEQ ID NO: 7572 - DNA, 311 bp, Diabrotica virgifera
  Clone ID: LIB3026-011-Q1-E1-H5
atacacagttttagacttatgtgagacaaattaatatgaaagtcagaataaactcaaaagtttaaaataaatttttgaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccccaaaagaatcaaacctaactaacccttaaaggaaaattaaaacccctccaaaagggccaccaaaatcaaatcaacgggccgcctttaaaaaactccgaaacggaaaaaacccggg

SEQ ID NO: 7573 - DNA, 174 bp, Diabrotica virgifera
  Clone ID: LIB3026-012-Q1-E1-A2
gaaataaagttaaaataattacattagttttttatttacgaattactttttccagtataactattataataggggaaatttatagaatatctaggaaaattaacaataatttgactaggttttctgaaggcatttactttaataagatcaactttatgtacagaaattttcaga

SEQ ID NO: 7574 - DNA, 407 bp, Diabrotica virgifera
  Clone ID: LIB3026-012-Q1-E1-A5
cacacgtccgccatcgcgtccgctttttttttttttttctagtaaataatgaatacgattttattgtattctatcgttacaaagctggaggaaaatatattcttgattattttttaaattaattctttgcttaaaaaagggctggtgctgcataagtgtatggtgccgctgttgagggtgcatctgtctatggtgcagctgttgagggtgcatctgtgtatggtgcagctgttgaaggtgcagctgttgagggtgcagctgttgagggtgcagctgttgagggtgcagctgttgagggtgcatctgtgtatggtgcagctgttgagggtgctgctgttgagggtgcagctgttgagggtgcagctgttgagggtgcatctgtgttatgggcacctgtttaaggtgca

SEQ ID NO: 7575 - DNA, 458 bp, Diabrotica virgifera
  Clone ID: LIB3026-012-Q1-E1-A7
ccggggccaccacgcgtccgtaataacaacaatgctagctgctaaagttgtcttgtttttgggccttgcccttttcgtctcagccggtgaagatcttgacatgggttatcaaattgtggaatgtgccaattacgtaatgagagcaggagtacccgaattgggagtaccacaacacgacccctacgtcaaactcagggacctacaatggagtggaaacctcggtgttgccaacgcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatgga

SEQ ID NO: 7576 - DNA, 255 bp, Diabrotica virgifera
  Clone ID: LIB3026-012-Q1-E1-A8
ccaacgcgtccgtaaatattttaatttttattattatttctatattaagatttattttagattatttttattttaattcttttataaaaattatagaaatgaataaccaatttaatattattaataataaattatctttaattaaatattttaattttccaaataatttaatcataataataataattatttatttatttatcactttaattgcagtagtgaaaattacaaaatttttatatggcccattacgac

SEQ ID NO: 7577 - DNA, 285 bp, Diabrotica virgifera
  Clone ID: LIB3026-012-Q1-E1-B3
ccacgcgtccggtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaacaaaaattaaaaaacaaaattttaa

SEQ ID NO: 7578 - DNA, 436 bp, Diabrotica virgifera
  Clone ID: LIB3026-012-Q1-E1-B5
cccacgcgtccgaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaat

SEQ ID NO: 7579 - DNA, 433 bp, Diabrotica virgifera
  Clone ID: LIB3026-012-Q1-E1-B7
ccaaccaccgtcaaatggaacggcggtgtgcgtttcgtcttacgttcaaaatataaatgctgctagaactggagtctaccgaggctgctttaacataacatcagaaataggcaacgcgtgtgatttgtttgtagaagaactctcgtctaatacatcaacaattaaattttgtcgatcatgtactacagatagatgcaacacagattatttgaatgaaaaaggtgcaaccaattataattacaacctggaatctttaataatcattaacatactagcgatattggttgctagtatttggaaataatatttaaagttacatagaaccagttgtaacctgtgttggataagagtacttgtatcttttgattaataactagagttaaggataaattagaaattacaatgttttatatttttttgtactcaattttta

SEQ ID NO: 7580 - DNA, 418 bp, Diabrotica virgifera
  Clone ID: LIB3026-012-Q1-E1-B9
ggcttttggagcaatgtgaaagttagcgcattactcacgaatgttataaatattgttgagccctttgtgtgtatgtggtacgactacgaacgagaatgtctggattgtgttatcagcaaacttgcccagtttgtaataaataaattagtgctgaaagctaatactaacgaagacttcattaaatgcgaatgtttgggggatttatcatttttaacaaagcttcacttgccatccctagttgaatcttgggagacagaagattacggttacataaaatatcatctaataaaaaatcccgacgtgaagaaagtttataataaaatgtataaaattgtttccaaaatagtggtggagacctttgaggaaatgtaatttttttatgaattgtaataactatttcaataaaaccaatcgatat

SEQ ID NO: 7581 - DNA, 388 bp, Diabrotica virgifera
  Clone ID: LIB3026-012-Q1-E1-C10
gtctggtagaggacatagtttggattattacgtaaaagtttacgctaagtaataaatgtattattttttatattataaaataaaatacatgaaaatcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgcccaaaaggttcaaacttaagttaaccttgaaagcaagttcaaaccccttcaaaagggtcaccaaatttaaattaatgggccttcgtttaaaaattttttaacgggaaaaacccgggggtaaccaaatttaacccccttgaaaaaaaacccctttttgcaattggggttaaaaccaaa

SEQ ID NO: 7582 - DNA, 396 bp, Diabrotica virgifera
  Clone ID: LIB3026-012-Q1-E1-C12
cggacgcgtgggggcgacattctttcatacaaagatcacttgaaaactaaaattttgaaggatgcggcaaaacggaaataatgataaacatttaaagcaatacttcagattattaggagctattgaagaaactgtaattcttttatcacgttagattcatttttaacataaaattatttaagcatattgtatggtatgtcgaaattaaatgattggccggccttggttttatttatttaataaacgtgtttcatatataagttgtttcattaaatcatgttacgaatacaaaagtgatattcaaatccaagtatttcattgatctatactaataattagattgtttattattgtctaaatatacatttatttatgtgctttatataaaattcgact

SEQ ID NO: 7583 - DNA, 440 bp, Diabrotica virgifera
  unsure (1)..(440): unsure at all n locations
  Clone ID: LIB3026-012-Q1-E1-C5
acaacatttgcaacaatacctggaaactgaagatagtactacgctgtccttaagcgaacatgaaaaagtacaagccgatcaaacgctcacgcaacgagactggagacgtcagaaacaaactcttgaaaggaaagtacacgaagaagactcaacactattaaaattagacgaacgaacaacggaaacgagtcaacaagatacagcaatcaaagattggcgtaaacgcagagatagaggagacgaaaaaattaaagaagatttaaaagaggaaactcaaactctggaaactgaagagaaagttccacaggaaccagttccttggaatcagcaagaaattacattaaagaaaacacctcgacaacgtaaggaagttcanaaagagactttggaagaagtaacccttaaaccattcagaaaatcatctgcaactagtcagacgg

SEQ ID NO: 7584 - DNA, 446 bp, Diabrotica virgifera
  Clone ID: LIB3026-012-Q1-E1-C7
gaattttaaactggaacagtgccacctcatgctcaataaaaacaagaattctattaaaacaacacattagtatacgaatcatgattttaaggatacttatcataacatgtttcatctcaatgatttatgcctcaagaattatcacaagagatgatccggtaccagacgagtcagcgtgtatatgccaccacggttacactattcaaaaacatccaaaagataataaattttactgtaaaggtatcctacatgatggaaaaacagcctgtgtaaaccttgagcgaccgcagtgtaagtgcaccttaataaaaggttttgttattcaagacatctatagatactggtgcgtaaaagtgaaacctgggtatgttgaagaaattagatgggattgtgaaaataaaaaagagtgggataggttttttgacatttacccggaggagcgacca

SEQ ID NO: 7585 - DNA, 321 bp, Diabrotica virgifera; identical to SEQ ID NO: 7415
  Clone ID: LIB3026-012-Q1-E1-C9

SEQ ID NO: 7586 - DNA, 436 bp, Diabrotica virgifera
  Clone ID: LIB3026-012-Q1-E1-D6
gaagaatttggcctgaatattacagctatttctcgagttaacaatcttgaagattttctattgcttgttagcaatctaacacacaacgtttcaatactgaacattggtcaattgtcattcggacaatcttcaaagcataaattaaatccgtttgaaaagaatgcttacgttgttgcggaaactgtctcgacattcagcgtttctaaagaaggtgatttggttcttaacgcaagtgcaggcactgtgcagtctctgaaacttgtaacagattttacagatcttcaaaagcgaccaagaattgaatataacctcactgttgtaacagaagtcaatatgacatggattaccaaatctggcccattaaagaataaagtaactaatctaccctcacatataagtgatccacagccatataccactccaaatttcactgctt

SEQ ID NO: 7587 - DNA, 450 bp, Diabrotica virgifera
  Clone ID: LIB3026-012-Q1-E1-D9
caaacgcgtccgggattgtcgctttatttcatgagttttgtaagaaaaccaagtttcgtcttccgctacaatgcgatcaagaaatttgtcccattcgttttgtcttatgagtcttctgtcaaaacctttggtacccacataacgtacattttttataattggtcaaggtgctcaatcactatttcatgtaacaaggatcgagaaatttgtggaaacgagtcatgcaatgtgattaaagtaggtcactgggtttgctgcgtcgtgcacactggttgttccttagttgaacatgatgcactatttcctcactaaaggttagctcacaacattctcaccataagcagcctttatttgcctatatatgatgatttggcgaacattttgcgcattcaaaaacagaatcatactgcgtacttaacattcggcgggattttcaatgtggcgtcccca

SEQ ID NO: 7588 - DNA, 184 bp, Diabrotica virgifera
  Clone ID: LIB3026-012-Q1-E1-E4
ccacgcgtccgtaatactttaaatttgatttctaccagaatgctaacaatccaagaatgcatttcgaccaagtccaatgccctgctgaaatcgttgccagatctggttgcagtctttaaataataatataatataattatttgttttaaaacaattatgttttacttaagtatatactcaattt

SEQ ID NO: 7589 - DNA, 180 bp, Diabrotica virgifera
  Clone ID: LIB3026-012-Q1-E1-E6
gtctgcccacacgtcggatggatcctcacgatgcatttcgcccatagtccaatgccctgctgatatcgttgccatttcaggatgcagtctttaaatagtaggacaacataattatttgttataaaacaattatgttttacttaagtatctactcaatttgcaattaattgaaattaatat

SEQ ID NO: 7590 - DNA, 451 bp, Diabrotica virgifera
  Clone ID: LIB3026-012-Q1-E1-E9
aatcggaggtggaatcggcggtggatccggcggtggtatttcatccagctacggcccacctggcaaatccggtccatactaattttcttactaagttacctctgcagtggttgccttccagtaactgctgcactacagtttgctgcaaaccacttcatccgctatttgtattttacccaacatagtattgtagattttaggacctaaactgagatgcgttcattggaaagatccgaggtaatcgttgtcgaaagctgaccatccaccccccaaaaaatatggcaattggttacgaggtgacacctaaaggcgcgcaaagtttggaaaaaagacgaaatacagtcaagtggagaatttgtattgtagcaatctgtagctattacctccaaaaagtgaatggtgatgctggtatgtctgctgtttgatacaaaaaccaaactcgtatgacgag

SEQ ID NO: 7591 - DNA, 441 bp, Diabrotica virgifera
  unsure (1)..(441): unsure at all n locations
  Clone ID: LIB3026-012-Q1-E1-F2
ctccggaaactgatagtagtgattttagccgcagtttgtctctacgacgtatctgctaaacaagatgactacgtgcaatgggtgagttatgatggtacaatacccgccaatgttgtggaaggaactacatccattgatggtagacaattatatattgcccgtgcctttgttagtttagatgagtctgatctttataatgacaatcaaggttacatagtaggcccagtggaagcaggagttttacaactcaatgctagttttcctgatttaacttaccatattaccgacaacattgagatcctaactgttgtggatggagccaaagtcgaatgggttagcacaaatcaaacatttttaccaaaatggtttgatagtgatgactaccatccagtgcactccaactggcaacaaattgttaatatanattcaaccatttatata

SEQ ID NO: 7592 - DNA, 432 bp, Diabrotica virgifera
  Clone ID: LIB3026-012-Q1-E1-G1
caaaaatgaagattgttttattagttttgttcgctgcttgtttgtcacaagccaaaataaatcaagatatacatttcgattgggtgcagtataccggagaaataccagagaatgctataataggcggatcaactgctgatggtgatccaacgtatgtagcccgttcgttcctcagtgcagatgaagatgatgaaaattactctggaagtgactacaatggttatgtagctggtggtgtgttacctggaaaattgtcgatcgacctttgtactccgcagagtatatacacgctcacaaagaacattgagatactgactgtggtcaatggaacaaaaatcgaatggattaaatcttaccagcacacattcatggacaacctcaactcaaacgaataacctcctgtaaagattcgtttgctaacaaaccgggaaa

SEQ ID NO: 7593 - DNA, 52 bp, Diabrotica virgifera
  Clone ID: LIB3026-012-Q1-E1-G2
ccacgcctccgcaaacgcgtcagcccacgcgtccgctagttctagatcgcga

SEQ ID NO: 7594 - DNA, 451 bp, Diabrotica virgifera
  Clone ID: LIB3026-012-Q1-E1-G3
ccacgcctccgtaaaactctatcaccgtctgcaccattgtcgtgaaacagatataaatctcatgatacatgtatcacaacttgtcgcgatacatgtgtcgatacctatctcaacgtgaatgggggccttaacatgcaagcaactatgctctgtttttaaacaaggaggagtaatttaaatataccgcgccgtaatgcttgtttgtaattggtcttctctcaggcaagtttagtccactcttatgaaattttggcactattgacacttatgaaattttgacagtattggcatttcatacgttaacctttaactatccgcgcatcaagtgataacataagtaaagcgtggcgtatttttatacacacaagaaaattcactttaaaacaaccgttttggccaatggttttaaataaccttaattggttggtaaaaaccttaatcggcatcaacc

SEQ ID NO: 7595 - DNA, 201 bp, Diabrotica virgifera
  Clone ID: LIB3026-012-Q1-E1-G6
gaaaaggttgatttggattgggaccacacatgggtccagagatgccacggatatagaaaaggtgtagatttttacaagaaatactttaatgttatacctataccacagcatcaaaattttaaacttgttaatgaaatctaggtaatgtgatatattagtaattatgtattttaaataaaacaagtatgatacaatcattaa

SEQ ID NO: 7596 - DNA, 162 bp, Diabrotica virgifera
  Clone ID: LIB3026-012-Q1-E1-G8
tccggaaggtggtcatttggactgtcattatttaatttacaaagaattttattgttatgttaaaaggcttaaatttttttataagacgagaagatgctatatagtttgaaagggttagtaggttgtgttttttgaagaaatctttgttatgtgatatatttg

SEQ ID NO: 7597 - DNA, 439 bp, Diabrotica virgifera
  Clone ID: LIB3026-012-Q1-E1-G9
aaactaaaaatgcaagacttcggcgaattcgttaaaaccatggaaaacaacaaaatggatcgtgtgaagaaaaacaccgaaaccatcaaggtaatggctgatatggtgttggaagaaatgactaaaatgtatgaacaactgctagtggatgttgcgaaagggactgcctcagagattgatgttaagacttcggaaaaaatgtgtgaaactgttgagcgtactacgtttgatattattcacaaaatgaaatttatatataatgaaggaaacatcatgttaaatgaatagttatttacagttttcgtctatgaatattatgtttaaaattattgattctaatattgaaatactttttggctgtaattttaaaattagaaaagaattattataacattttcatcaaaaatttacataaaataaatggtaatacttagattcg

SEQ ID NO: 7598 - DNA, 253 bp, Diabrotica virgifera
  Clone ID: LIB3026-012-Q1-E1-H1
cacgcgtccgttactttacattctgattatgataatgtgattataaaatatttttaacaaaacaatttccaaaaataaacaaaacaaaaaccaacaaaaaaaaaggcccaaacacaaaaggaaccggcccataagcgatcaggaacgccatagcccaaaatcgcccgtacactcaccgtccattggagccacgaggcccggttctatggccccgcccatcagataccccggccgagaggcgactgggaccccc

SEQ ID NO: 7599 - DNA, 451 bp, Diabrotica virgifera
  Clone ID: LIB3026-012-Q1-E1-H11
cgaacgcgtgggtccagatttattgaatattagaaaaattttttttagggatagtaacgtaattttttaggtaaggacagttcattagtattgagagagaccacgatattggaataaagtatataattagtgtatgtaccttgtgaatcagggagtacgacttaagaaatataacatgatcagtgtcgaattcggtgtaacccaagtaggaaactatctattgtttaataataattttaaatacgttttgtgtaatgaaatgttattcgttttaaaataagactaattttttaagaaataaattagggtggacgatcaacaggatccttacttatataatacttctatgctacgtcatatcaacatctttttagggatgagcttacaaatcacagttcatcaaaattcaacttcgagattgggattacgctgacgttatttcatattttcg

SEQ ID NO: 7600 - DNA, 268 bp, Diabrotica virgifera
  Clone ID: LIB3026-012-Q1-E1-H9
acgctatccgccagcgcgtccgtcattattttatattatttttcagtttcttgtttcgcttaattttctttaatgatctttaattactattgtgccctactatgttatttttacccactaagagtttattttatgtcccttcgtgtatcatggattagtcgtttctaattagatgtgtattattttcgattttaccttaccctatctatttatcttttttccgctctttttgatcctcatcttctgtttttgtgatgaaatgtccttc

SEQ ID NO: 7601 - DNA, 407 bp, Diabrotica virgifera
  Clone ID: LIB3026-013-Q1-E1-A10
accacgcgtacgatttttagggatgagcgtatggataaaattttattagtctttaatttttaaataaaaattaggattaacaattttcatattttaaaatatgttattagttatttttatacattattatttttattttttataaattttttattaaaatataaatttaaattatttaaatttagtaatgatgataatattagtattaaaaaattgtctatttagtaaaaatatataggtttaataaaggaattctgcaacattttttttcacctgtttagtaaaaacatgtccttttgtacgtaaattaaagtcccccctgcccactgaataattttaatggccccggtaatttgaaccgtgctaaagtatcataatcattactttttttattgatcgctggaatg

SEQ ID NO: 7602 - DNA, 359 bp, Diabrotica virgifera
  Clone ID: LIB3026-013-Q1-E1-A12
accacgcgtgcggcaaagaaggctgacaagaaggaaaccaatgccatgtcaaatggagtgagcaagcgtggtaagaggaaagaggaagagaaggaggaatcagctgaagaagaaaatggtgacaaaggcagtgaagatgaagaagaggaagaagatgatcaataaattgttcgaagacatttcctttgcttttaaactattttttatacttaaagcttaaaatttacgtatttactttcagtatcgatacttttaagtttacttaacagtacacacttaaattacttaatttttgactgatttgaatttggtattagtacgaatccaattccaggaaaatgttgcaaaagcctctcaat

SEQ ID NO: 7603 - DNA, 238 bp, Diabrotica virgifera
  Clone ID: LIB3026-013-Q1-E1-A5
cgtccattctagatcgcgaccggccgcccttttttttttttcctattttcttcattcgcaggggggatttctcatttacttgtccataatatataaccacccctgaagacttcatcagcaacattgggcggacacaccaggggcaccaaggctgccgcctcctggacgacaatttggaacacctccaaacgggttggatgcatcagcttgagtagctctacagtgtcacctatcatac

SEQ ID NO: 7604 - DNA, 372 bp, Diabrotica virgifera
  Clone ID: LIB3026-013-Q1-E1-A6
ggcacgtacctagccacgtaccttgctagcgcgcccgtgatgaaattacgaaataagtagttttacgtcgtttaattattgatattgtaatttttttaagttgtcaggaattaacatttaggagacaggatgaatcggagcattcgttaaatcaagttaattatagagaacaaataaaattgtttaacaaatacgatctggaattttctaatttactttttgactcgaagacatttaacggcgtacctaaaacagcacagaatgaaagaatcaattagtagttacattttgatctttttcggtagaagtagacgaatctactgatagaggtaacatgtcattcacaattatcaattgttcttaatatttatg

SEQ ID NO: 7605 - DNA, 410 bp, Diabrotica virgifera
  Clone ID: LIB3026-013-Q1-E1-B10
agtgttttataaatgctggaatgttccacagggtgacccgtactttggggggagatcacagtttgattggtgcacccggtgtgcaatgacaagttgcctgtctagcaacaatattgttacaccggtattgttggggaatagggctacaacatgttaaagaaatgacttggatcggacaggtttgggaaattcgaggcatcggaggtgaccaatttttaaggcagtgcgttaatttcttggagaagtggatttattaattcctacatattcttttagaacaatatccatgttcaaactaacaaataattttaatgattgtatttttatacttttacgttattgttaaaaattgaatgtttaaattctatatgattaatttttatctgtgatctttagtagtctaagtgtat

SEQ ID NO: 7606 - DNA, 251 bp, Diabrotica virgifera
  Clone ID: LIB3026-013-Q1-E1-B12
aattgaattacgcaaatatttttttttattttcaattcttacattatttaagaacttaagctaatttacctttaattatcaaccaagagaggttatgactacaacaacaaatttaacattgaattgaaaatgacacgacagtgagtttcttctttcgaccctacatcaaacttgaagttaccaataaactgagtaagaacagtattaggtctacaaaatattccagctagattttgactaaaggcctctcg

SEQ ID NO: 7607 - DNA, 427 bp, Diabrotica virgifera
  Clone ID: LIB3026-013-Q1-E1-B7
cccacgcgtccgatttttatttagtttaaaataataaaatattttttagtaaaagtatagaaaaattttatttaatgatagttaattagtattgtgagagaaaagtttatttttataaaagaaaaatttatattttggtacctggggtttcagggataattaattaaaattatataattaataatttcgaaatttaaagaacccaaaaatttaaaattttaatggtaaattaaaaatttaaaaaaattttttggtaagaaaaggtaatccgttttaaaaaaaaccaaatttttaagaaattaaattaaatttatttataaccattatatttaaaattaaaaattttaaaataataaatattaaatatttatagggataaccttaaaaataaaattttataacaatttaatttttaaataaaatttgg

SEQ ID NO: 7608 - DNA, 328 bp, Diabrotica virgifera
  Clone ID: LIB3026-013-Q1-E1-B9
aatagtctgtaatttttcttccctttcttgtttttttatagacatgactctgtcagttttttcaatctgcctctagtaagttgtaattccatcgttgtcgtggtcttcccactgatcgtcttcctattggggcaccatctttcgctgttcttactactctttttgttgtcattcggcgtatgtggtcattccactgtaatcttttatataataaaaatataaaaaatattatatttaaatataataaaaatattattaggaaacatttttttcaactgtaaaataaaaaaaatagtcttttgtattaaatttaaaagtctaaaacaag

SEQ ID NO: 7609 - DNA, 383 bp, Diabrotica virgifera
  Clone ID: LIB3026-013-Q1-E1-C2
gaaattgtgaaatgcgcccagcgagcaataagcgtaggagtacctgaattaggagttccatcacataatcccttcgtcgttatcagaaacgtatcatggactggatcaatcggtgttgcaagcacccatatcgaactcaagagcaataaatggtatggtcttgccgattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatgattaaaccaaaatgggctggaagaatcagcgcacaaaaagtccccactgtctt

SEQ ID NO: 7610 - DNA, 383 bp, Diabrotica virgifera
  Clone ID: LIB3026-013-Q1-E1-C4
atcacccaaccgctcgccagctcacagggtagcttgaatgggcgcgggctattgtcccagctacagtagcttaatcactaatgtctgaaatgaaagcgtttttgaaagggtggattgactttatgtacctctgtaaccagggattagtaaattttaattacaaatttattattttcaaatttataaaagctcaaaagttcccatttttattgtaaaacattttttataaataattttattgtaataaaatgttaatcgattttaggtaaccaaagtttttatgaactaaattaaatttatttattaacaatagatttatacttacctatttttagaccaataatattaaatttttttaaggatgaccttacgagaaaaatttt

SEQ ID NO: 7611 - DNA, 286 bp, Diabrotica virgifera
  Clone ID: LIB3026-013-Q1-E1-C5
gaatgggagttagggcccaaaaaagtcaccgaaatggggaaacaccaacaacatgtaaaagaatttaaaaaaaaagaacaaaatcacaacaaaggccccaaaaaattcaaaaaaaaaaaaaaagggggggccccccaaaagggaccaagccgacccaaccctccagcgaagaccaacgcccccccaaagggacccccaagttaacttcacggggcagcgtatcacaaggcccggcagggaaacccccgggggggaccaagagtaaccccctggagcaaaacccccc

SEQ ID NO: 7612 - DNA, 420 bp, Diabrotica virgifera
  Clone ID: LIB3026-013-Q1-E1-C7
ttttaagccagtaaaactgtggtattttttttcaatgcatcatcttttttaataaaaaaaactttggttaatggggcattacatcgcaaaaccgtaatttctaaataatatcgtcttaatttatttatctaacagtgtactgtctaaataacattcgtaaaccctgtacatttttttaatagtcaatttttatttgttcccatcctcatcagttttgcttacctttttttctctctcaaaaatatgatttcaaaataatctatgttccattaccttccaaaaataatataaaacggttttattatatcagcattgttgtaaatatgacaacttatgtgtatcgatggtttttttgatgtccatagctgtacgtgttagcctaaagtgtagtcatagctttggcaaaaaacatccccgttt

SEQ ID NO: 7613 - DNA, 360 bp, Diabrotica virgifera
  Clone ID: LIB3026-013-Q1-E1-C8
atttttatttattttaaaataataaaatattttttagtaaaagtaaagaaaaattttatttaatgatagttaattagtattgtgaaagaatatttaattttaataaaggaaaatttaatttttggaacctggggtaccaggaataataaattaaaattaaaaaattaataatttccaatttaaaagaactaaaaaatttaaatttttaatggaaaataaataatttaaataaattttttggaaagaaaagtgtaacccgttttaaaaatataccaaattttttataaaatataattaaattttatttataaccaatatatttaaattaaaatattttaatattattaatattaaatattt

SEQ ID NO: 7614 - DNA, 378 bp, Diabrotica virgifera
  Clone ID: LIB3026-013-Q1-E1-D1
cccacgcatccgcccacgcgtccgcccacgcgtccgggataacaaataaaaggatagcttttcccttaagtacgaacacttcttctacagccaatcaaaatcaaacgcttccaaacctgccacctcttgcacaacctttaacgaagcctccttcaactttggacagtacttgtgaaagtgtgtgccaattattaaactctgaacaatctagacaaaattttgaaaacatatggaagggtcaattaccagaacaatttcagaaaactgttagcttaatggtaggatgcttaacaggtaataataaggaagcagcaaaacttcataaagaaacgcttctgactgaatataaaacgctttgtgaccgatggatagatgaaa

SEQ ID NO: 7615 - DNA, 418 bp, Diabrotica virgifera
  Clone ID: LIB3026-013-Q1-E1-D11
gaagaatttggcctgaatattacagctatttctcgagttaacaatcttgaagattttctattgcttgttagcaatctaacacacaacgtttcaatactgaacattggtcaattgtcattcggacaatcttcaaagcataaattaaatccgtttgaaaagaatgcttacgttgttgcggaaactgtctcgacattcagcgtttctaaagaaggtgatttggttcttaacgcaagtgcaggcactgtgcagtctctgaaacttgtaacagattttacagatcttcaaaagcgaccaagaattgaatataacctcactgttgtaacagaagtcaatatgacatggattaccaaatctggcccattaaagaataaagtaactaatctaccctcacatataagtgatccaaagccatatacca

SEQ ID NO: 7616 - DNA, 103 bp, Diabrotica virgifera
  Clone ID: LIB3026-013-Q1-E1-D4
aaggaaaattcctgagcctaaattcgaacctgaacgttgcattcccggtggctgcggacgctgacccactgaaacaggccaaatttcaagtcataaaactgaa

SEQ ID NO: 7617 - DNA, 274 bp, Diabrotica virgifera
  Clone ID: LIB3026-013-Q1-E1-D5
acccacgcgtccgttcaagcgtatgttcatttgtatcgctagtcgattcagatcgctgagacagtatgaggaatgtgtttgtggtagtaaaaggtttagttcgtggtgggggcgtggtcaataggtatgtttttaggggtgggatttagtattttgttgacattatttatatttttatttgtagtattattatggttgatatgttttagtatagttatacttatagatttttctaagttatttataaggttgatatcttgatgtttttaatgta

SEQ ID NO: 7618 - DNA, 409 bp, Diabrotica virgifera
  Clone ID: LIB3026-013-Q1-E1-D6
tatatttttatttattttaaaataataaaatattttttagtaaaagtaaagaaaaattttatttaatgatagttaattagtattgtgagagaatattttatttttataaaagaaaaatttatttttggtaccttgtgtaccagggattattaattaataattatatattaataatttccgaatttaaaggagctaaaaatttaaaattttaatggtaaattaataatttaaataaattttttggtaatgaaaggtaatccgtttttaaaatatacccaattttttaaagaaataatttaattttatttataaacaatatttttaaatttaaatatttttaacttataaaatataacatattttaggggatgcccttaaaaaaaaaattttttattaaattttaattttt

SEQ ID NO: 7619 - DNA, 302 bp, Diabrotica virgifera
  Clone ID: LIB3026-013-Q1-E1-D9
gaaaatttatacttaccaaatatttttagtgttactaaaatgccatacaaaccattataacaaagtacttaagcaacgatggtgaaattgttttatttcattcattacttttattataagatttataagttcgtagtacctaatgtatttgtcaaaaaattgttatgccaaaagatcttacagctcgtactgttacacagtattgtgatttttgacagtttgttcgaatattaggattaggtttcttatctgatttttgtatgtagtgtcattttgtattattaataaatgctataagcgtc

SEQ ID NO: 7620 - DNA, 389 bp, Diabrotica virgifera
  Clone ID: LIB3026-013-Q1-E1-E1
acggacgcatgggcggacgcgtgggtgttttttcaatctgatctggattactcccgttttgccttgagactttattacattattagcacaaacctactattttcattgcatttgccacctgatgtcgaacttcatcctgcacgtcgcgtcgccatggctagtgatgtctattctgaactttctatattttcgaaatccactttcagctaatttgtgttgtagttgacttcgtacatgttctttgtcttctcatagatctcctgcccacttattcgtaatataccaagttcttctttttcctactttataaataggctcatgcctgttttacttcgattcttcgtctcaattgacgttgtctgaccatattttcctcggtcgtcccattg

SEQ ID NO: 7621 - DNA, 413 bp, Diabrotica virgifera
  Clone ID: LIB3026-013-Q1-E1-E12
accacgcgtccggtcgaaaaatgttttgtgtatttttaaaataagacaatttgaaaattgatttttaccataccctttaaccgtttcctaacaattgcactaggtaaagatccattttcatgtactgaatttagactattgatttaaaatctacttaattttcaaattagaagcatgcactggtataccggtgcaatcgaactaagagtcattcatattcagctcagcggggtgatattcttcaaggtgtgaaactttatcaacaagagatctacctgttttatggaatgatcccttgattatttaagtacacatttccaataatggtgtcccgctgagctgaatattaatgactctcatagtttgattgcagaactatattgtcatgtcttagttccacgtaatttaactgt

SEQ ID NO: 7622 - DNA, 267 bp, Diabrotica virgifera
  Clone ID: LIB3026-013-Q1-E1-E4
tggcttccaaaactgttcttttcggactcttggtagtccttttggtcaaccactctttggcaagatatccgactgtctgtcccaactcagatatggcaaccaaagctgtatacgacaaacaagtatcaccatccgttgtatgaagcaccacccgtgttagagtaccagacagcttgttcttgaagacaaccttcacctgcattgcaaatgtggacaataaccacagccataacgtacctgaagtacaacatggtggtgtttaccgta

SEQ ID NO: 7623 - DNA, 280 bp, Diabrotica virgifera
  Clone ID: LIB3026-013-Q1-E1-E8
aaagcccttcttaagtccaataatagctgagagaactaaagaaacttttgggtaacggaggcggcggcaagcacgtcacatacgaagtggttccacatgcatcccattcatcagctcacgtttctacacacgaaaccgcctatgctggtggttccggacacggaggccgctatggaggagaaatccggcggcggcgctaatgccggcggtggtcccggcggatggggtaggtctctcaatgccaaacctttaccatacaggggacatcaacaagccaaac

SEQ ID NO: 7624 - DNA, 363 bp, Diabrotica virgifera
  Clone ID: LIB3026-013-Q1-E1-F1
ataaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagtagagtctggtagaggacat

SEQ ID NO: 7625 - DNA, 172 bp, Diabrotica virgifera
  unsure (1)..(172): unsure at all n locations
  Clone ID: LIB3026-013-Q1-E1-F2
attaaaatatanatttaaaattaattaaaattaagaaatggataataaaataagtattaaaaaattgtaaattaattaaaaatataaaggttaaataaaggaattcggcaaaatttttttcaaccgtttattaaaaacaagtctttttgtataaaatataaagtcccccctg

SEQ ID NO: 7626 - DNA, 310 bp, Diabrotica virgifera
  Clone ID: LIB3026-013-Q1-E1-F3
accacgcatccggtttgacaaacaggaaaagaaacctaaacataagtgactcaaaaatgatttttcgtgcgataatagacaaaatctacctaatacccattcttcttaaagtcggtaatataatttattttatttatgatcttgtaaatgttattctgttgtgtttggcgattgtcctgcaagcagttaaataaaacttgcccaaaacggtttccaagtttcagtcaacacttactgtattttaatccgttatgtaattttattgtatattatcaaatacatttggatttggaataaaaagatacacttg

SEQ ID NO: 7627 - DNA, 363 bp, Diabrotica virgifera
  Clone ID: LIB3026-013-Q1-E1-F5
agaattttgtaacgaaggtcttctgtggaacgtacacattccaggatgcgatgaaaactctgattgttctcaactattagtttccactgaaaaaacagatgctccaactgcagcacccaccgaaagtacaactagtagcgtttgccaagaaggtgatcgaaatgagtatatacctgattgccacagattttttgaatgccaaaacaatagatgggtaggtcctttccaatgtccagctgatctttactggagccaagcaaataaacgatgtgtagtactagcgcattcagattgcattaaacattaacgagagaagatattaacacataaaatgaatttgacattacaaccgaagactttact

SEQ ID NO: 7628 - DNA, 376 bp, Diabrotica virgifera
  Clone ID: LIB3026-013-Q1-E1-F8
agtccagccagctccgcagactggtctgtatggactggtaaacatagtgacatgtattggtcagctgtcctgaaagggctaatagatggtttgttctagtttcaccagctttatgtggtcaatgaagtactaagaggaaaataattacacattccaaagaaatatagtgtttttattttaagactaaattagatgtgtatttagaaactgaattattttttaacttactcaataaatttaaaggtacaaaataggcgcataaattctcaatttgatacataaagaatattctgtgttatatagaatactttttaatgtatcccatattcgacttattttcctccattacatttattacaatgattttttaattccg

SEQ ID NO: 7629 - DNA, 357 bp, Diabrotica virgifera
  Clone ID: LIB3026-013-Q1-E1-G1
atctctttgtagggcttaaagtttgaaacgaacaattttataactagttttaggaaaaaataaactaatttaggaaaaaaaaaaaaaaaaaaaaaaaaaaaaaaaaaaaaaaaaaaaaaaaaaaaaaaaaaagaaaaaaaaaaaaaaaagaaaaagaaaaaaaaaaaaaaaaaaaaaaaaaaggggggggcgcccaaagggagccaagctaaagtacgggggaagggaaaggcaaagccccccaaagggggcaccaaaatccaattcaaggggcggcggttaaaaaggtcgggacggggaaaacccggggggaacccaactaaaacgcctgggaaaaaaaccccctttcgcaaaggg

SEQ ID NO: 7630 - DNA, 291 bp, Diabrotica virgifera
  Clone ID: LIB3026-013-Q1-E1-G12
cccacgcgtccggtttgctctgttcatacatgaatgcaaatgaacaagatgatggatacaatgacatatttggcattgatgaaatcagcatttatgaaggagaatggaatgaaaatgtatactcagtttcaggagaagttttagatacatacttgtatgatttattattgaactacttggaagaaaaaggaatctccaatgattttgtagaaaaactctcgaaatatagtacaacatatgaacactcagcatatattgtactatattacgaaagtttttctacacaatgtt

SEQ ID NO: 7631 - DNA, 71 bp, Diabrotica virgifera
  Clone ID: LIB3026-013-Q1-E1-G4
aacaaaaaaaataaaaaagaaaaaaagattaatacccaagcgcagcccaggcgtccggttctaaatggcaa

SEQ ID NO: 7632 - DNA, 105 bp, Diabrotica virgifera
  Clone ID: LIB3026-013-Q1-E1-G7
cccacgcgtccgcccacgcgtccgcaaatttcaaacaagaaaatgatcgtacaagttaacaaatacgggtccgaattaagtccaaaaccattccaaaacgcccct

SEQ ID NO: 7633 - DNA, 133 bp, Diabrotica virgifera
  Clone ID: LIB3026-013-Q1-E1-H1
ccgacccgtccaattttatatattttaaaataataaaatattttttagtaaaagtaaagaaaaattttatttaaggatagttaattagtattgtgagagaatattttatttttataaaagaggaatttatttt

SEQ ID NO: 7634 - DNA, 380 bp, Diabrotica virgifera
  Clone ID: LIB3026-013-Q1-E1-H4
tggggttaatttaaaataagaaaaaaatttttaagaaaaggtaagaaaaaatttaattaaaggaaagtaaataagaatgggaaaaaaaaatttaattttaaaaaaggaaaaattaatttttggaacctggggtaccagggataataaattaaaaattaaaaattaataatttccgaatttaaaagagctaaaaaattaaaattttaatggtaaaataaatattttaaataatttttttgtaatgaaatgttatccgtttttaaaaatatcaaattttttaagaaataaattaaatttatttattaacaatatatttataattaaatatttttatattagtaagattaaatatttttagggatgagcttaaaaataaaatt

SEQ ID NO: 7635 - DNA, 387 bp, Diabrotica virgifera
  Clone ID: LIB3026-013-Q1-E1-H8
atttgaatttaaaatcaaagtagaggacaatagagatgactacggcaatggtccatttgaaagtgaagctgatacaacaatatttattattactaaagacaacaccgttgattttcaattttacaacgatattgaggatgttcaggacagagaaacaccgatgttaaaaataatatccgatatagtgggatatgatgcatatcgtcaaaatatagatacagtaacaaatagcggtctcgttaggaccagagcaaggctttatttcattgacagtaaaagcagccgtcggttgcaactcactaaaagtcccgcagacagtggattcgaactggttaatagtgaaacaatattaaacatagtgaccaatgtgaacaccttccaaaatct

SEQ ID NO: 7636 - DNA, 415 bp, Diabrotica virgifera
  Clone ID: LIB3026-013-Q1-E1-H9
atttattttaaaataataaaatattttttagtaaaagtaaagaaaaattttatttaatgatagttaattagtattgtgagagaatattttatttttataaaagaaaaatttattttttgtaccttgtgtaccagggattattaattaataattataaattaataatttccaaatttaaaagagctaaaaatttaaaattttaatggtaaaataaatattttaaataatttttttgtaatgaaatgttactcgtttttaaatatatcaaattttttaagaaataaattaaatttatttattaacaatatatttaaaattaaatatttttatattattaatattaaatatttttagggatgaccttaaaaataaaattttattaaaatttaatttttaaataaaaattaggattaaa

SEQ ID NO: 7637 - DNA, 397 bp, Diabrotica virgifera
  Clone ID: LIB3026-014-Q1-E1-A1
atttggcgcatgatcaaataaaaaggattactaagaataatccaggaaagaaagcatatcgtaaggtaaactacggggcaaaagaccccagaactcgtggttgaaagacctgagaagatgagatgaccgcttatccgcagaaatttttcgtgcagtagtttccaaagctataattgctatttggattgcgaaccttcgaaaggtgacggcgcaataaaaagaagaaagaagtaaacacaaaactattgttaattactaataagtttacatgaagcaataggtatattcgctgaagtgatgctgaattaatcatactttgattgtctatacatatgaaacacagaacaagtcgagaagttatttttactgttgaatgctaaattgtccacgtagttac

SEQ ID NO: 7638 - DNA, 409 bp, Diabrotica virgifera
  Clone ID: LIB3026-014-Q1-E1-A10
ctcattgggcttcagaagaatttgtattttgtaagcttttccaaaacatatttgacttattttatatatttcaatgagtgatagattattttaaatatttatattttttatatttagttagatctgtaagtgattcattatccccggtcatttaataatgtaacttgctaccaaaaagtgttataactttacattgttcaagattgggttattctggagtataattaaatactttgtgatggataaccgagtagcttcatgtcttaaaatatcgattttataaaaaaaacatttttcttatttggataattattcaattatcgttgacttcaatttaaagttttaatactttttggtagcactttcaataggttttcatattcatcatttaaatattttaagagttcat

SEQ ID NO: 7639 - DNA, 250 bp, Diabrotica virgifera
  Clone ID: LIB3026-014-Q1-E1-A2
aaaagctggattgacgggttggatggaaaaaaaactgtcttcaattaagttatgcagaattttatgtttaagttaagaagcttaaatttttttagcagactagaagacccgatagagttttatgaaattattaagaagtttttttagcatgaaattgatttaaatgataaatttacttaatgggggtgagtacaacagaaggttaaggttctttagagtatgagaggaattaacaaatttttgatgcaaa

SEQ ID NO: 7640 - DNA, 383 bp, Diabrotica virgifera
  unsure (1)..(383): unsure at all n locations
  Clone ID: LIB3026-014-Q1-E1-B1
gacccaggcctccgcagacaataattttaacaagagcaaganactatccagaacacgaacangcaacagaaagatgaaaacaaaattgatcagctttttaaaaatgatgcanaatttaacagatcagacacaaagtttaacatcggaggtaaaaggaataaaagaagaacaacgagaatatagaaatgacctccgagaattaagaaaagaaataaatgaattcaaacaaagtaaccaacaactacaaaaagaaaatgatgaaatgaaacaggaactaaagatagtgaaaatgaaggtagaaaagttcgagaaagagagaaaagctaacaatgttattgtccagggtctaccgatggatacaaataacccaaatgtagtcaatg

SEQ ID NO: 7641 - DNA, 411 bp, Diabrotica virgifera
  Clone ID: LIB3026-014-Q1-E1-B10
agtttatggtaaacatggaaatagtgagaggtcacattctagtgttttgacagttctcttacgtcagaaattttgacctacgtgatgtcgcttttgtagtaaaaatactatatgtacctattatgcaaagttgatcaaatcaaaacaacctacttctttgcctaaaaacatgcgggatatattttactttcacctgtgagagactacgacgtattctttgcgcaattttgttcaaactgtgactatagagcataataattatatgttccctcgtggctatataactgatattttgtcaaaattttaaagtttaaaattgctgcaggcagcaatagtttagtaattcaacgttttgagctatacagccatgttttaataatatatttatatataagttgctgtagtaggatg

SEQ ID NO: 7642 - DNA, 412 bp, Diabrotica virgifera
  Clone ID: LIB3026-014-Q1-E1-B3
agcaaagtataaaaatgaagcagatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgtttaaaagagtttgtgtga

SEQ ID NO: 7643 - DNA, 403 bp, Diabrotica virgifera
  Clone ID: LIB3026-014-Q1-E1-C1
acaatttgtcgttattgattgtatcaggaggtaaatttccaacttatcctccttttcacgtgattgtaatattatcttgtaccccgtatcgcgctttgacactatcatttttttcatattcttttctagttttgtctactagctttccgctatcttagcatactttgtttttattagtatcttctgtagtttctattccgtttatgaaaataagtgtacccgcaagtgttgtatattctaactttactatcctgctcttatgtacgagctttggtattgaccactagtttgtaactttttgactaatctgatacgatcatgcagtttgcttgttagattacgaacattgatttttagaagattacaacgcttcaaaaacattggatatctcatatatttaaaa

SEQ ID NO: 7644 - DNA, 406 bp, Diabrotica virgifera
  Clone ID: LIB3026-014-Q1-E1-C5
acccacgcgtccgcccacgcgtccgatcttgacaagggcatggaaattgtgaaatgcgcccagcgagcaataagcgtaggagtacctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactataccacatactggcccagttttagaatcgtaggcaactacgaagcaaccgttaaagagcttttccttacacagcactacaaaggaacctacaacataaccatgattaaaccaaaatggactggaagaatcagcgcac

SEQ ID NO: 7645 - DNA, 333 bp, Diabrotica virgifera
  Clone ID: LIB3026-014-Q1-E1-C6
aaccacgcgtccgtttcaacgcactattctaataagggtccgaagccagtgcagaatccagtgcgatcaaccagttgatgtctcagttaatgtggccatccaccagggaatacgatcatgatacggatgtacatccaatgatataacatatgctattaacaacgtttggaacatccgtttgggaatcagattgtgaagacaatcatgcaggcagtcattacggcgaacttcacgaaccgattcacaaaacaccacgctttagaccagggattccttccaggaatgcatcaagaaatagttgtcgtttaatgtgtagtcacgtgtcgattccca

SEQ ID NO: 7646 - DNA, 185 bp, Diabrotica virgifera
  Clone ID: LIB3026-014-Q1-E1-C8
actaagcaaagtaacgaatactgtaaattgtgtaaatgataactttatacaaaatacctacctgccgagaaatacgattcccgatatgattaccggtactcaaatacaaaagtaacaaaagtaatcatagtaatcaaagtaacgaatactgtcaatgatcactttagacaaaagcaacgatttgt

SEQ ID NO: 7647 - DNA, 295 bp, Diabrotica virgifera
  Clone ID: LIB3026-014-Q1-E1-D3
aggattactaattaataattatatatttacgtagtttcgcaatttactaggagctatgaaaattgacatttttattgtagaatcaatattttacatactgtttttgttctgaaatgtcacacgattttagatacatcgaaatttttagatcgaacagtacatctaattattagcaatatacttataagtgacacagttttacatcaataatattaagtacctgtaaggacaagcttaaaaataccccttgattataattgaatttttaaatcaaaattaggattaccaattttca

SEQ ID NO: 7648 - DNA, 356 bp, Diabrotica virgifera
  unsure (1)..(356): unsure at all n locations
  Clone ID: LIB3026-014-Q1-E1-D4
accacgcgtccgcgaaaatgattgcttttgcagtaactttttgtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtacgtgacgatagaactataaggagtcgtacccaatatatcaattcagagacaaatgagagacacgtcctagaaggagaaacacaaggttcaacaactgnggaaggcaaatttatagtacatttcttaaatccagacgtaactgta

SEQ ID NO: 7649 - DNA, 404 bp, Diabrotica virgifera
  Clone ID: LIB3026-014-Q1-E1-E11
acaagattggtttggccttggacctggaggcttaaatatgttattacatcttgttccacaaatacatattagcgcccatttaatatatttaagaatcctgtattgtagataataattatttaaacgggactttagtgttatactttattactcccgttgtgtttagttcagttgctcctcccaattactccttttttacacgctatacgtatatattgtttttattattaaactctgaaaggcgcgcttttccggatattttcaaagattgatgtcaagttaggagcatatgcattttatgtcaaaaaattagattgggattgtgggtcttagatggctacaaaccgctttgtgtagttttgcaattttgcaaaacattgcgaattttgcagtaaatgtggatt

SEQ ID NO: 7650 - DNA, 278 bp, Diabrotica virgifera
  Clone ID: LIB3026-014-Q1-E1-E6
aaaaaaactcaaaatattcccgatgccatgtcaaatatttaaaattgtcactgattgtcagtgtctgactgacaatatgctgacaatattctattcgactgagttcgttgtatgacaaagatagatttggaaaatattaccacggacattgtgttcatttttttcgaatcctgaaaaaaccaataaatatttttgaaaaatttaaacgcagaatgaaagactaaattattagtgagggccgaaagtcccttaaaatacataaaaaaatagatcaaata

SEQ ID NO: 7651 - DNA, 450 bp, Diabrotica virgifera
  Clone ID: LIB3026-014-Q1-E1-F1
attccgagtccgaccacgcgtccgaagataaccatgaaacaaccagtatggactggaagaatcagcgcacaaaaaacccccacagagttaaaacctaacaccactgtagacagttttaccgtcgactggcacgttgcagatgtaaaatgcaaaatcactggtatgggattacttggagacacttatgctctcgctattcaagaaggtattgaaggtgccctcaaccatggtcttatcggaaataccgttggagacttccttaaaatgagattcaacactgtctggtatcccactggcaaagtctggcaaatgctggattaatgcaactccctcgtgtccaccccagatgcacgacaagcctaattttaatccaataatcagggtaaattagaagggtattttcctttgtaaccataaaatacaattaaatggtaataattattattcacc

SEQ ID NO: 7652 - DNA, 401 bp, Diabrotica virgifera
  Clone ID: LIB3026-014-Q1-E1-F6
agcaattaattttgtctgttcaacgaattcttaaagtattttttatgctccgattttagctaattttttgttgtggtttgcccgagaagtacaggtaagtgtgttggacaaagtggcctttcgttaattatatattgggaatgaaaagagaatgaaaattttcaagatacaatatttaaaactagatcatggaagaaagaggaaacttcaataaatgtatctttcttccagtttctgaaaccgtccgagctacaccgtgtagtgtgccgatagactaacgtagaataaccacaggctgttcctgtggaaaatactggatgttataaagatgtccatatctttaaagcactaaagaattgagctcacaacatatctgggcactattgaagcattgatgaacg

SEQ ID NO: 7653 - DNA, 427 bp, Diabrotica virgifera
  Clone ID: LIB3026-014-Q1-E1-G1
atttttatttattttaaaataataaaataatttttaagaaaagttaagaaaaattttaattaatggtaattaaataataatgggagagaaaaatttaattttaaaaaagaaaaaattaatttttggaacttggggatcaaggaataataaataataagtaaaaaattaataatttccaaatttaaagaaccaaaaaaattaaaattttaatggtaaattaataatttaaaaaaattttttggtaatgaaaggtaatccgttttaaaaaaaatcaaatttttaaagaaataaataaaatttatttgttaacaatatatttataattaaatatttttatattattaatattaaatatttttagggatgagcttaaaaataaaattttattaaaatttactttttacataaaaattaggattaaaaattt

SEQ ID NO: 7654 - DNA, 317 bp, Diabrotica virgifera
  Clone ID: LIB3026-014-Q1-E1-G11
acccacgcgtccgcaaaatgatgttgaaaattgtgcttcttttaagttgtgttgctttagctattagcaaacctgaaggaacatgcccacataccaccgatgaaacccccgtatatctcccagattcagtggaatgtgcagtattttatgaatgtgataacggagatccaattaagttgacctgtgctcctggaacatactttaatatagaaaagagtctttgtgaaactcctgacctcgtggagtgtggagatagaacaactacaatttaaccctccagctgaacacagatattctgaattgccaatattatcatc

SEQ ID NO: 7655 - DNA, 411 bp, Diabrotica virgifera
  Clone ID: LIB3026-014-Q1-E1-G3
accacgcgtacgaaaaatcggtatttcttggggacttcaaggcgcaggaggtgtacagtgtgttccatttgaagtgggagggttcattagatttccggaaggacggaaaatatgacaacaatgtgatttgcactataatattggccgcattggaggacccctacctaccaaaaaatataagaatcgtccaagccgttttcgagataattgagtgtttccatacatggaactcactctgcatacataaatgtatatttatatattaataataactattacacgaaccacaaaaaaatgggataggaactcaaaataatctattattgtaacagttataccgtaaggcactgtaaggtaaaaaatacatcatggtcatttaatataattcaatcctttgatttatatgtaggt

SEQ ID NO: 7656 - DNA, 178 bp, Diabrotica virgifera
  unsure (1)..(178): unsure at all n locations
  Clone ID: LIB3026-014-Q1-E1-G4
accacgcgtacgaaaattcagtanaatgagaggaaagaatttaataataatacatttgatctaaggaaaccaaatctacccattttttgaataattcaaaattaatcaaaatcatgaaatatttattataactataaataatttggtaaaattattttttacctatagcaataaatag

SEQ ID NO: 7657 - DNA, 384 bp, Diabrotica virgifera
  Clone ID: LIB3026-014-Q1-E1-G7
agtcccttgcgatgattctctcatactctctgttgacttgacggatggtcctcgggtccgacatatcccggttctgtccatggatggcggctaaccttctagctatggagtctacctttccttgggcttcgaagtggattccctcatcgtctatgatctgtggcatcctctgttttcctcacgtcttggatttgatcatcttccataagttgccgtggttttcttctgcttttcggatgaggctgtgccactttgcttcgttgagggtgctgagtcgttgtcatatctccgttgagagttcgtcagcatatgtcgtgtattcttccctcctgcttctttggtatgttcgtcaggctctgtgtctgtccttgatttattaatata

SEQ ID NO: 7658 - DNA, 405 bp, Diabrotica virgifera
  Clone ID: LIB3026-014-Q1-E1-H12
agcagtttgatgttatttttggggttattaaaaggattttataaattgatctattaataaaccatgagtactcaaaaaggaaatactggccgtactcgaccccagaaacacaaaaatcgttcagctttcaaaaataatctccatgataccaaccacagaaccaagatgatcaactctattcaagttagtgatgtatgtgctcgatgtaaagatattatagaatggaaaataaagtataaaaaatacaagcctctgacgcagcccaaaacttgcaataagtgtggattaaaaacagttaagaaggcataccatgtcatgtgctcagattgcgggaagaaattgggagtatgcacaaagtgttgtgagaaaagggaagtttttgtggctgaaccaactgagaaacaa

SEQ ID NO: 7659 - DNA, 386 bp, Diabrotica virgifera
  Clone ID: LIB3026-014-Q1-E1-H2
aactgcacctacagattctccacctgacccagcaactgattcatcatctgcttcacctagagattctccacctaatccagcaactgattcatcaactgcttcacctacagattctccacctgatccagtaactgattcatcatctgcctcaccgacattttctccatctgactcaacaactgcttcgtcatctggttcatcgacagatttatcaagtgactcaactggtgcaagacctgagtcatctacgaaaggttcagctgcaagtttatttacagggaccacatattttatggctacatttgtaatcgtggttttacattacatcttaatatcagttaattcagtataaatatttttgtacttatgcacgattgttaatgaat

SEQ ID NO: 7660 - DNA, 374 bp, Diabrotica virgifera
  Clone ID: LIB3026-014-Q1-E1-H4
acaatttcaattatatatattactaattttttaagaaataaattaaatttatttattaacaatatatttaattataaatatattgttaataaataaataattttacattattaatattaaatatttttacggatgagcttaaaaaataaattttattaaaatttaatttttaaataaaaaataggattaaaaatttcaaatttaaaaaggtattatttatttttatatattagtagttttatttttaaaaatttttactaaaatataaattttaattatttaaatttagtaatgatgataatattagtattaaaaaattgtatatttagtaaaaatatataagtttaataaaggaattcggcaacatttttttc

SEQ ID NO: 7661 - DNA, 379 bp, Diabrotica virgifera
  Clone ID: LIB3026-014-Q1-E1-H5
acacgtctgcaattttgggatcgtagagattaaatttgacataaattttttaaatcagtttttgtttaaacagcttccggacgtgtcattcctaacggacagaactttgctaactaatcgcaaacgcatacagggcggtttacgtcgaaagcgatccatgtataacgttacttaaatggagtgacagacgatacacgccaggcagtccctaccttttcgtagaatcgacggtctcacgatccaggcttcaatccatgtgtcactagtcggttttacatcataggacggcatatatcatgaattggcaaatcctgcttcatcacagacaattgaaccgctctctggcgatttttgttatgagtgttgccacattttgttt

SEQ ID NO: 7662 - DNA, 386 bp, Diabrotica virgifera
  Clone ID: LIB3026-014-Q1-E1-H6
aaaacaacaatgcttgccgctaaagttgtcttacttttgggccttgcccttttcgcctcagctggtcaagatcttgacaagggcatggaaattgtgaaatgcgcccagcgagtaatgagcgtaggagtacctgaattaggagttccaccacatgctcccttcgtcgctattagaaacgtatcatggactggatcaatcggtgttgcaagcacccatatcgaactcaataccaataaatggtatggtcttgccgactgggatatctcagctaagcaaatcaatgatgactctgattacgaggctgtctttgactacaccacatactggcccagttttagaatcgtcggcaactacgaagcaaccgttaaagagcttttctgtaacag

SEQ ID NO: 7663 - DNA, 416 bp, Diabrotica virgifera
  Clone ID: LIB3026-015-Q1-E1-A10
gtccaaatgaacacacgcacttttttatttttagtggtttttcttattgtggcacaaagcgctttttgtgccccaaaagataaaaaacacaaaagcaaaggcaaatataaaacttgggttgatcaaaaccaagtagaacttgagggcgccaaaaacagagtcatcaaatacatacagaaaaatgaccccgataccacaagggcaattaacgaactactagaaccagtgaaagacaaatgtccacaggtcgacaaggtaccgaaactcttggatgacgtatacggttgtgtgaaaaatactacagtaggttcaggcactgtgtgttcaacaattcagaaaactatcgaaaaatgctacggacctttaatcgatcttgtcggaagctgtttgcccaaagaatccaacgaattgccttt

SEQ ID NO: 7664 - DNA, 396 bp, Diabrotica virgifera
  Clone ID: LIB3026-015-Q1-E1-A11
catccaagcgtccaattggcggacgcgtgggcgattattttcaattgagagatattttaccaaaacaatttgagccgatgagattctacggtgtaatttttgtaaatacttaaagagcgtgtttcaaaaatgcgcttaatataatatattatcaatacagagcaacctttttttctttattattttttcttgttgaacaatatataaagttcttgaactccctaagtggaacatagagcttcagtgaaaatgcaccatcacctcattccaagactttccttgacttcttaccaattgttggacaattataactcagattaattttactaggtgacagttccataagtaaaaatatgcaatggctatatattgcgtactaaacttaagaagaaaaat

SEQ ID NO: 7665 - DNA, 403 bp, Diabrotica virgifera
  Clone ID: LIB3026-015-Q1-E1-A2
agaaatcacataagtaatatttttaaatatgagtgtgaggagataggggggactatcactaatgcaacatttttaaatcaagtgttcctaagttgtaagtactcttgtactatattgtattgtactatcttatattatatacagctgaactatcagggcatattattctaaagcaaaattctcaaaaatgaaggctaccttagttttggctgttttggtttgcgtcgtaggtttaaccgttagtgcgccccaaactagtgaccactgtaatgcctgtgtaggtttttcgtccatggtcaagaactacgtactcaatcaacgtccattggaggaagttgaaaaagactcagaggatttatgtcaacgtttctacgatatgaaagtgagaaatttttgcgaaaat

SEQ ID NO: 7666 - DNA, 376 bp, Diabrotica virgifera
  Clone ID: LIB3026-015-Q1-E1-A6
ctatgcattcggcgcagaaacaacggctttgacatgcaacgagctaacttaccaaggctgaaaattcctctttggaatacaactcaaggtcaaaagaaacacagtgggtctgtatacagacctctttccgaagacctctcgggtcccaagactcctaaattgagtcgctatgaatttaatacaaccccagtagtgcatactgcttaaagttacttaaaattctgtggttcatagataaataagactattttgtttaatatgtagataatcaaattattgtctcttatgaaataagattaacgataaagtattcggctgactgcaatacggcagataacctagggacaacattccattacttctgtgaaccaaaacc

SEQ ID NO: 7667 - DNA, 417 bp, Diabrotica virgifera
  Clone ID: LIB3026-015-Q1-E1-B1
ccacgcgtccgcagcaatgcttgccgctaaagttgtcttacttttgggccttgcccttttcgtctcagctggtcaagatcttgacaagggcatggaaattgtgaaatgcgcccagcgagcaataagcgtaggagtacctgaattaggagttccatcacataatcccttcgtcgttatcagaaacgtatcatggactggatcaatcggtgttgcaagcacccatatcgaactcaataccaataaatggtatggtcttgccgattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacat

SEQ ID NO: 7668 - DNA, 438 bp, Diabrotica virgifera
  unsure (1)..(438): unsure at all n locations
  Clone ID: LIB3026-015-Q1-E1-B10
acgcagtggggcgccantcttcgccatcnggcctggaccgtaacctggttcttgacaaggttccaggtcnncagctttccnnaagttaccgatgggagaaatgtgagaatgtctcnaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaatctgttgctgaaattacagttggtggagttggtcacgatttcgtaaatgtacatttgacatctaagaaaggaggacccctacattacgatgttgaaatttacgccagggccccaaataataatattaaataataagtacattaatcgccctaaaccactattgaaaatatatttata

SEQ ID NO: 7669 - DNA, 357 bp, Diabrotica virgifera
  Clone ID: LIB3026-015-Q1-E1-B11
atctaatttataattaattttgggaatagttaatgaaatatttctttttaaaatacttttgtaactttgtatttaaagttgggatgtatttgttaaatacaattagattattgggttggggttttatttttatcttctaatatttgtgaatgttattagataaaaattgtaatggccaactttggtgtgtaagcaagggggcagcttaaagcttttcgataatgaataaatgttttttgttaatatagttcctaatgtattttcgtcaaatttaatttgagtaaatagactaggatatatatttattcgctgtttagatttagattattgctgcatagaattaaataacttaaggct

SEQ ID NO: 7670 - DNA, 263 bp, Diabrotica virgifera
  Clone ID: LIB3026-015-Q1-E1-B12
cgcgtccgaccacgcgtccgacttcgcgtccgaacagacttttgggaactgttccgttaaaacacttgtcacaattagcttcgtttggcaagggttccgcgctcttaaagctctgcaatctgccagccctggcagtctattgggaagcaccttaagatcgtacgatctcaactcattgctttcgtacactctttggggtagactgtgtggtaactcagtggcactgggttacctgtcacgttcacttttcaactcatagactt

SEQ ID NO: 7671 - DNA, 371 bp, Diabrotica virgifera
  Clone ID: LIB3026-015-Q1-E1-B5
cagaacgtgggcaaacatgaagacttccattgttttagctattttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaac

SEQ ID NO: 7672 - DNA, 383 bp, Diabrotica virgifera
  Clone ID: LIB3026-015-Q1-E1-C10
aatgaaatgcgacttacttcccttgcaagcgacctttgctggtgatcctctgaatcaagggcaccagtaaagaactaacgttataaaagcgtctatatttgttgttatacaactatagcagctgagattgagagaaatcaaagtgaaaaacctctctttcgtttggaaaaacatttattccctttgtattaaaaacatttactagctctctagccgttataacacaagctataaaatcagtttgtcaaatattagttaacaacctaataataataaagtatctgatggtatcagttaataaagttagcaactatgcagttcacagttcacataagtttcagaacattttagcataagacttattttgattgatatatttaaag

SEQ ID NO: 7673 - DNA, 419 bp, Diabrotica virgifera
  Clone ID: LIB3026-015-Q1-E1-C11
aaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcgggaacaatttttt

SEQ ID NO: 7674 - DNA, 430 bp, Diabrotica virgifera
  Clone ID: LIB3026-015-Q1-E1-C3
ccaacgcgtccgtgcgactccacaaacagggtaaattttcgatattttgcttggcgttagagatatcgaaaaaagttatttgaaaaagttgttccaaatattctatccccacataccaggtttcatgacggaattcttacttttggtttcttcaatattttgtagtcaggaccctaaatgatctgtcccgagatgcaagtccggagatgttgcatctctggacagcccatttagggtcatctcatgactacaaatagtgaagaaactaaaagtgcgaattttgtcatgacatttggtatgtggggttcacagattaattttttatttaggttgactttttatatagcctgattaggcatttatccaaaataatatgtgaatcatactacatttaaattttttctaatgactcacactttacattttttgc

SEQ ID NO: 7675 - DNA, 405 bp, Diabrotica virgifera
  Clone ID: LIB3026-015-Q1-E1-D3
tactgaaacctatcaacatttttaaaatgtacactaagtttactgttgttgcccttttattgtgtgttgctttaaatgaagtacatagcggagttatactcggcaaaggattaggtagaagttttacagcatgtcctgatcccctgaacccaggaatattggtatccgacaacgacatttcaggaggtctcttcgaatctatcaacttaagagttccagaaataggattgttagaaacgcctatttcatgcatattgatcgttgataaaaagaagagttcaactgacccaattattggtgcaggaggtgtaggttctccatatgttgaaataagtatcaaaccaggattcttcgaagctcttcattataggattgaagtgtacatgaaagcacctgataccacgc

SEQ ID NO: 7676 - DNA, 449 bp, Diabrotica virgifera
  Clone ID: LIB3026-015-Q1-E1-D4
cagacgcgtgggctgacaaaccatttgactacatttggtatgccccttcaacatggtaccgtattagatatcttcagtacgtttgaagagctgtagtttttgggtacttctcgtttatcttatttcaacattaacaatctggcataaatcatctccaaagatactttcctactaggctacagctatttgaagatgataatatattattcaataactcaaaaacagttgacaaaccatttgactacatttggtatgtcccttcaacatggtaccgtatcaaatattttgagtacgtttgaagagctgtagtttttgggtacttccttcacattcatcttcttttaacattaacaatttggcataaatcatctccaaaaatgcttccatgttgggctacaccttttgaagatgatgatttttatccaataactccataacagtttgacaaa

SEQ ID NO: 7677 - DNA, 409 bp, Diabrotica virgifera
  Clone ID: LIB3026-015-Q1-E1-D9
atttttgaagaatatttaagtaagaaattatgggaaggagttttactggacacatatattccagatttaatagaagagtctcaagtactaccaaatttcttcaacaactctcatattgagcacttgttattgtttctagaaaagtttccaagtgtagctaaagatttgccattggaagattttgtcgttagagctagaaagaagtattacgatgtctataatgtcgtcaaaaagtctaagaaatacaagaatgttctgaatcatggtgatgtgtggcaaccaaactttttctataagtttgattcaaagcacaagccaagcagtgctatagtttttgattttcaactattgaggtatgcacccccagctttggacttacttatgccgctccatgttaatgctacaaaac

SEQ ID NO: 7678 - DNA, 444 bp, Diabrotica virgifera
  Clone ID: LIB3026-015-Q1-E1-E1
caaacgcgtccgcgatcttttttattttactgagcctgatgttcttggaatttgtcgttggcgatgatgttcaatattatactgattcaactacatctgctcctgatcctgctcctttttggacaacggcaccaatacccagatccacaagcattggtgaagatgtagtttacgtacaagatcgacaagttcccgatccaacctatgagatagatgccgtggaagcattcaaagaagctaaggcacttcatccagttgttgacggtacacaattgttagaaacattttccaagttgtttaacaacaaacatccgatagatggaggatggaaagttgttgaaaatttgggcccactttacaatccaaatgcagactacatatatattgaactgagagttatagatgctaatggagataggacaatccggatatctaacgcaaaaa

SEQ ID NO: 7679 - DNA, 411 bp, Diabrotica virgifera
  unsure (1)..(411): unsure at all n locations
  Clone ID: LIB3026-015-Q1-E1-E12
atcgaactcaataccaataaatggtatggtcttgccgattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccactgtcttaacacctaagcccattgtagacagttttaccgtcgactggcaagttgcagatgtaaaatgcaaaatcactggtatgggaataattggagacacttatgctctcgctattcaagaaggtattganacggccctcaaacatggtcttatcggaaatacc

SEQ ID NO: 7680 - DNA, 114 bp, Diabrotica virgifera
  Clone ID: LIB3026-015-Q1-E1-E4
atataatttacttagttcttttctctgtattttagtaattaaatttcatcatacattttaagaaaacatgtattttgtgttcacttaatacaagttttcttacaatgtaagaag

SEQ ID NO: 7681 - DNA, 134 bp, Diabrotica virgifera
  Clone ID: LIB3026-015-Q1-E1-E7
ataagtggtgtagcaactatactagtagatctgttcgactttaaaaattttacatgatccgagtttaaaccggtgtgaaccaagttggttgctaacattaattgattgcgatacttaactccaaatggaccatt

SEQ ID NO: 7682 - DNA, 425 bp, Diabrotica virgifera
  Clone ID: LIB3026-015-Q1-E1-E8
ataaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttaattttatatattattatatttatattttataaaatttttattaaaatataaatttaaattatttaaatttagtaatgatgataatattagtattaaaaaattgtatatttagtaaaaatat

SEQ ID NO: 7683 - DNA, 388 bp, Diabrotica virgifera
  Clone ID: LIB3026-015-Q1-E1-E9
tgtctttgactacaccacatactggcccagttttagaatcgtaggcaactaacaagcaaccgttaaagagcttttccttacacagcactacaaaggaacctacaacataaccataataaaccaaaattgactggaaaaatcaacgcacaaaaagtccccactgtcttaacacctaagcccattgtagacagttttaccgtcgactggcaagttgcagatgtaaaatgcaaaatcactggtatgggaataattggagacacttatgctctccctattcaagaaagtattgaaacggccctcaaccatggtcttatcggaaataccgtcggagacttccttaaaatgagattcaacactgtccggtatcccactggcaaagtctggcaaa

SEQ ID NO: 7684 - DNA, 380 bp, Diabrotica virgifera
  Clone ID: LIB3026-015-Q1-E1-F7
acgatccgatagcagcagttatacgccgtggtccactactcgccgtcccacctactggccaacgggcacaacttggtggccaacagaaagatcgacacgatccgatagcagcacttacaggccttggtccactactcgccgtcccacatactggccaacgggcacaacttggtggccatcagaaagatcgacaccatccgaatccagcacttatttgccttggtccacgactcgccgtcccacctactggccaacgggcaccacttggtggccaacagaaagatcgacaccatccgatagcagcacttatatgccgtggtccaaatactcccccgtccaacctacagggccaacgggctacaacttggtggccaacagaa

SEQ ID NO: 7685 - DNA, 424 bp, Diabrotica virgifera
  Clone ID: LIB3026-015-Q1-E1-F9
attggcaacaattcaataatttacaaaagtccagtgggtttaaagtaaccttgggttaatttacaaaaaaattttatttggtaaaaaattgcaaaaaatcctaaaaaccatgcaataactgcaaaatttgtaaacaaacaatagcaatttcctaaaaagaacttccgtagcagctatacaaatttaaacctctgtttaaaaaatctgaattaagagtatatgatataggcacataaaagtgatgtcgaaattaggagtacaaaatgttaatttttaataattaatttggcatatgagactaactgaaggcaaacaaaacttaataacatcataaaatcattgcaataaaaaactgaaaactttttgtcttccatgtttttatgtggcgcaaaaggtacaaaaacgtaaatctgtaatttaaaac

SEQ ID NO: 7686 - DNA, 438 bp, Diabrotica virgifera
  unsure (1)..(438): unsure at all n locations
  Clone ID: LIB3026-015-Q1-E1-G6
caaggattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgatnatattagtattaaaaaattgtatatttaataaaaatata

SEQ ID NO: 7687 - DNA, 273 bp, Diabrotica virgifera
  Clone ID: LIB3026-015-Q1-E1-G7
atttactccccttcctttggcaactgtccttggaaccggtttaaccaccaaagaagtcaacccaagtgaaggtaaagttggtggagattcaaaacgatgaaacaaactactacaactactgctcccgctacgtgtgactgtgaacaatgtaacactcattgcacagaggaaagcaaattagacccacccaaaaactacgctggaggagtctgtgtagataataaatgttattgtgtcgaaattgtttaaattatattcctttatattatcaat

SEQ ID NO: 7688 - DNA, 392 bp, Diabrotica virgifera
  unsure (1)..(392): unsure at all n locations
  Clone ID: LIB3026-015-Q1-E1-G8
catttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttaattttatatattattatttttattttttataaattttttattaaaatataaatttaaattatttaaatttagtaatgatgataatattagtattaaaaaattgtatatttagttaaaatatataggtttaatacaggaattccggaacaattttttcaactgtttattaaaaacatgtcnttttgtattaaatat

SEQ ID NO: 7689 - DNA, 445 bp, Diabrotica virgifera
  Clone ID: LIB3026-015-Q1-E1-H1
caaacgcgtccgggttttagctgtattgtttcttattttcttttgcgaggttttgtctgtaagtatctccaacagacagaagactccattacctatagcttcccctccaaattatgacccagatctgtccaatataatcaaaagtattcaaaatatggaaggagttgctgaaaattttacgaaaaatattttaaggaaccactaccgtaacttaaatcaaaatttaactgatctagacaggcgtttagctgccactacaaatgaagacatcatcggcagatgtgtttctcgtttccaattctcccagtccattaaaaccattgttaacgaacaaattaaaaattgcgctaccattgttttggctgaataccaaaacgtaatcaccaacagtttaaatatggcgcaaggtgttatgaaattttcaactattgtctggacagacatc

SEQ ID NO: 7690 - DNA, 368 bp, Diabrotica virgifera
  Clone ID: LIB3026-015-Q1-E1-H3
gaattatttttgcttcggtattttcatacactttcatatgacttctaaccttgcgatacacaggaaaatttgatactttgtgtttcttcgttctagtcaaaaatgcattactttacacttcacaaccaaagacgtattattatgcattatgtaagcgttgagcacaccatttgaagtgtttataaagtgtgtccaccaagaatgttcgataatataaaataactttatcttttactcttagtatattatcacattcctcgaattgaaaacaattatatgttttgcatttttgtaatcattgggaagctatttcgtattgtaaccaatttctctataaataaatgtatatatttataaaagaaataaaa

SEQ ID NO: 7691 - DNA, 309 bp, Diabrotica virgifera
  Clone ID: LIB3026-015-Q1-E1-H6
ccggggcgccccacgcgtccgaaaagatcttaaagtcaacgaacagtattcctttagagtttgttgtaaattcgaaggtacaaccgaatggtctccatggtctttgcctcaagtaggttctaccagtcttaaacccttttcctggcaatttagtcaagattacgagttaacaaatgaattcaaagtggcaaaacctaaaaaacatgatgtggatatgcggtattcagagggtgctcaattttccgctgggtatgcgagtgattttatgtttttagaaggtcacccgagcgatgcagtagtgggtcttgt

SEQ ID NO: 7692 - DNA, 330 bp, Diabrotica virgifera
  Clone ID: LIB3026-015-Q1-E1-H9
agtacctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactacaccacatactggcccagttttagaatcgtaggcaactacgaagcaaccgttaaagagcttttccttacacagcactacaaaggaaactacaacataaccatgattaaaccaaaatggactggaagaatcagcgcacaaaa

SEQ ID NO: 7693 - DNA, 237 bp, Diabrotica virgifera
  Clone ID: LIB3026-016-Q1-E1-A4
ccaacgcgttcgcttgttttgaacgagatggtgttttcctagagagtctcttcctcacaacaagacaccaatatgttacagaagacgatatagataatcttgtcaaagttctaatagacaacaatctctctgtagatgatttagtagtagatagccaagattactgctattataaataaaataaatatattagaaatatgattttcttatgtaaaaattgtaataaattttaatgtt

SEQ ID NO: 7694 - DNA, 212 bp, Diabrotica virgifera
  Clone ID: LIB3026-016-Q1-E1-B11
acaacaacccaacgttaatcaaggaaatgttcaacattaagaactgaaacattaaattgtagactttcatcgtttgaatataaatgtcttgtaaaggaattctgcaatctgggtgaaaagatgaaggatgataaatgagggaatgagtataagttgagcaatcagttggataattacgttaggtagtttatgcagagcagaaattcagggtt

SEQ ID NO: 7695 - DNA, 422 bp, Diabrotica virgifera
  Clone ID: LIB3026-016-Q1-E1-B4
ccaaagcgtccgcccacgcgtccgatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatat

SEQ ID NO: 7696 - DNA, 431 bp, Diabrotica virgifera
  Clone ID: LIB3026-016-Q1-E1-C11
acccacgcgtccgattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttatattttaaaaattttttattaaaatataaatttaaattatttaaatttagtaatgatgataatattagtattaaaaaattgtatatttagtaaaaatatataggtttaataaa

SEQ ID NO: 7697 - DNA, 411 bp, Diabrotica virgifera
  Clone ID: LIB3026-016-Q1-E1-C12
cgggcccgtttcattatctatactttcattcgcaacagaagttttctttattgttacatagctgacacatgcagatgtctagtagtagtagtatctgaactgttggacgtacgacccttttaaagaaactgttgccgtacatacagctaccgacatctatgagaagctcctgaaactcaattttaatgctggcacttataacctttcttaggacgacaagctgggaccttagaacattcccccgtcaataactgaatgacaccttgattatttctaatttccacttaattctaaagtatcttctatctatcaaaagtcattaatggcatgcaaaggacttaaaaggaaagaatctaaatattatttattgtatttgttacttattgtataggttcaaaattttaatgatat

SEQ ID NO: 7698 - DNA, 212 bp, Diabrotica virgifera
  Clone ID: LIB3026-016-Q1-E1-C6
cataaaaaaaaaatataaaaaaaaaaaaaaaaaaaaaataaaaaataattaataaagaaaaaaaaataagttttatgtataataatttagtattaattgtatatttttttaattctggtgggggttgttatagttggagttgaatgaattattgattttttaagataatatttgtttgttattatgatgttttaatttgtatattttttttt

SEQ ID NO: 7699 - DNA, 418 bp, Diabrotica virgifera
  Clone ID: LIB3026-016-Q1-E1-C7
aacacgcgtccgatctcagccaacgaacaacatagataaaaaatagcaaaacgtaaaaatggcaataacaaacctgcgaagaaaattctgactaaagaaaaccaaaaataaagcaaagatagatgactgataaaatccttcttctcatggacaatcggagaataatgaaaagaaaaaacggacaaaggtataaacaaatagagaaggaaatcaaaaaagaaatcagaatagcaaaggaagattttataaaagaaaatatgaagaaatagagcaattgcaggcaaaacatgatatttttaatgtacataaaaaagtgaaagaacttgcaggtacacaaaaacgtaagcagccaaatattatgtataatgtcaacggaaacataataacataactagaagaacagtttaagacatggaaa

SEQ ID NO: 7700 - DNA, 418 bp, Diabrotica virgifera
  Clone ID: LIB3026-016-Q1-E1-C8
aacacgcgtccgaaatgcttgaagacgatcaatgctaaaaaaactaagactaccaaaatatgcttggaagcatttgctggtctcagtgcaatcaataaataaagttaatggattttatttgtgagatactacaaacataacctaaaaatattgctattggctatactagataagagcatagtttctatggataagagagacctgcgtaataaaatactactggtacaaatgcttgaagacgattaatgctaaaaaacctaagactaccacgcttatttatcaaattttacaaattaagttgtaatatattaatgataggaacttttagcggttattagaagtgaaattattttgcgataacttgtaaatctatgttagaaaacaacgtgtgatctttttgttacacatcaacacaatg

SEQ ID NO: 7701 - DNA, 443 bp, Diabrotica virgifera
  Clone ID: LIB3026-016-Q1-E1-D1
tcaaattaataataaagggtcgaatataatttaatggttcacaaattccgtattaagaagatagtcggttcgctaagctcagacgcagctggctagtgattttagtaggccattttttgttttttgccagttttgccaaaattggttagtaattttggcaaaattactaactaggtatttagtgattattttttttttgccaattttgccaaattggcaaaatgacttactggggtcactggccggttgtgtctgagtttagcgaaccgactatagtagtccagtggtttacagactctataaaactaataaatggaaatatctgacaaaaaaaaaaaaaaaaaaaaaaaaaaaaaaaaaaaaaaaaaaaaaaaaagaaaaaagaaaaaaaaaaaaaaaagaagaaaacaaaaaaaaaaaaaaagggggggcccccctaaagg

SEQ ID NO: 7702 - DNA, 458 bp, Diabrotica virgifera
  Clone ID: LIB3026-016-Q1-E1-D10
cggtctaggacccccggggaaaaatgagcgacgaagaatagccctatttttagttttttaagttttaaatgggcctctgggtttgcgtataatacgaataataaaattgaatttcaagatgcaaattttttgaaattaagtttaataatgtcacaaacattcttcagaatcagtatgtaatggcatattctacatcagttaatattgtaacataacctcaatttttctcaggtaaaacttgcaatagtcaatctttaaaatactcaaaaacgttgggaatggtagattgtctcaacaaccagaggttgtgttgaaatgttttacgcataaagttattaggtcaaaatctgtgatatacgaggcactagaaattgcgtcatgatttgtgttaggtcactcgttataactttttatatattttatgaattacttatatgttctatctttattatagtatg

SEQ ID NO: 7703 - DNA, 308 bp, Diabrotica virgifera
  Clone ID: LIB3026-016-Q1-E1-D11
acccacgcgtccgaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccatgacgactgttattgtgcatacattaattaaatatgttgaaattgcaccagcattttaataatatatagttttttaccatgtaaacaataaagtagt

SEQ ID NO: 7704 - DNA, 278 bp, Diabrotica virgifera
  Clone ID: LIB3026-016-Q1-E1-D2
ggcaaaacttacgtttgttcttctggccctagtagccatcgttgtcttatcaaccactgaagtcaactcattggtccaagaaccaggtaccctcaaagcgtccaaagcacttggtttcaagcttagtgatgatgatacctgtacatgtgccaaatgctccgattcttgtatagcagtggataaagatcataacgttggtggtatttgccacttaggtgattgtttatgtgtttatcattaataatgttttattagttaataaataaagttttaggttt

SEQ ID NO: 7705 - DNA, 444 bp, Diabrotica virgifera
  Clone ID: LIB3026-016-Q1-E1-D7
aaagaataataagaatgaaaagaagaaaaaggaaaaaaaagaaaaaaaagaaaaaagaaaaaaaaaaaaaaaaaagacaagtaaaatgagaaataagaacggggaagaaaagaataaaaatgtaaaaaaaaaaaaaaataaaagaaagaagaaagaaaatgagaaaataaaaaaagtttaaagaaaaaaagataaaataaatatttaaaagtttattttttgtaatgaaatgttattcgtttttaaatatatctaattttttaagaaataaattaaatttatttattaacaatatatttataattaaatatttgtatattattaatattaaatatttttagggatgagcttaaaaataaaattttattaaaatttaatttttaaataaaaattaggattaaaaattttcatattttaaaatatgttattatttatttttatata

SEQ ID NO: 7706 - DNA, 359 bp, Diabrotica virgifera
  Clone ID: LIB3026-016-Q1-E1-D9
acggacgcgtggggctttggtaaaactagatcgtgatgtggaactaaacgaaaatgtaaaaatcgtcaaacttccagaagcagatgcagacattactaaaaattttacctctgctggttggccttatgcggctattactagggaaaaccaagacatcctacaattacgaagtgtaccatttttagattataaaacttgctatgatcaagtagcagcctacgtagcccttggtcgtactgaacctctcgatgaagcttgggataatatctacctaaacgaaacacaaaacatctgcacaggaccaaaaggtgcggaaactgccgtttttacaaaaggttaccatggagggcccttgattc

SEQ ID NO: 7707 - DNA, 91 bp, Diabrotica virgifera
  Clone ID: LIB3026-016-Q1-E1-E1
aaggggttgggaatgaaagaagctgtcggtaattaatttataaagagttttatttttaagttaaaaagcttgacttttttatgagacatag

SEQ ID NO: 7708 - DNA, 422 bp, Diabrotica virgifera
  Clone ID: LIB3026-016-Q1-E1-E10
acccacgcgtccgcgacactgtgggtataaatgaagtctttattcaaagtattcaccatttacccgagcacaacgatgccgttgattagccgaaggattcattgatcccagaactcctgtggaaatgaacagtcttccccgtatacatccggcgttgaatagcaactggtttaacaccttccgctgtcagaaacctgataacgccccgctgctcctcaatcgtcgaattttgcaatgtgaacgccatgatgtgctcacacgaactgtcgcgtcaattggacggctctcttataagagcctctattctctcctgcgcatgcgggcgcccgggaatgccccgatcgaatccgaatgctacatttgcctccctggatgtctcactacgttatcccataacggcatacgcaattatgtttgcggtt

SEQ ID NO: 7709 - DNA, 423 bp, Diabrotica virgifera
  Clone ID: LIB3026-016-Q1-E1-E12
gaaccagataccgaaatacaatactcgtctcctaatcagtacattattactgctacagatgacaaccaactgattagtgaacctaagccgattgaaactaatgaagtatcagacacagaacccgaaacaccagtgtttgataacagcagaatagccctctatttcagtaataaccaaagactaaaaaaagaaacacaagaagcaagtgtaggtgaactaaaggaagaatcaaaagaaagtgaaacggttcaaatttaaaatatagtttttattttggataattgctcaaaaatattgatgtgtcaatgtgactgaaaaaaatggcgtagttgttgaaaaatagtattgtacgatcttaaaaagtagtaatttattgtacgaatatttagttattttaatttagattgtttaaattaagatata

SEQ ID NO: 7710 - DNA, 341 bp, Diabrotica virgifera
  Clone ID: LIB3026-016-Q1-E1-E2
ctattaaaaaaaaaaaaaaaaaaaaaaaaaaaaaaaaaaaaagaaggaaacacaaaaaagaaaaaaaaaaaaaataaacataaaaaaaaaaatgggaggccttccaaagggttccaaccttacatttccctgcaggtaacttcataactcttcagattggtaacataaattcatttcacgggccattctttttcaacctcatcaccggaaaacccctgggtttaccaaacttaaggcccttgcagctcatcccccttatcaaaagtgcactattaatgacaagggcgacaccttttgtccttccaaaaaatttcccagccgtattgtggaaaggcacaccc

SEQ ID NO: 7711 - DNA, 409 bp, Diabrotica virgifera
  Clone ID: LIB3026-016-Q1-E1-E9
aattactattagaatcttttaataacaatcgtttgtaagtaacagatttttacaactttctaaaattttgctgccaaaagggagagattgtctcggtttctttttggttggctgtcatctcttgtctgcaaataattacatttcaaatgtcaaatttgtttttcatttttagcgtctctggccattaagatattctcgtctttcactacttacagacatatttgggcttccagagacttgcaccttctttaatttttacactttgcatccctcgtttttttttaatttcaaatacctcattaaaaaatcttttggttattctaagggacatttggccctcagtaataatgtaatctttcattctgcgtttaaatttttcaaaaatacttattaattttctccggatttc

SEQ ID NO: 7712 - DNA, 450 bp, Diabrotica virgifera
  Clone ID: LIB3026-016-Q1-E1-F1
acggtcggtaatccggggcgcaccagcgtccggcagattaaacaatggcttccaaaactgttcttttcggactcttggtagtccttttggtcaaccactctttggctagagatctgactgtctgtcccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgccattaccgaactgctcagctacagaatccaagtgtacaccaatgaataaatatagattgtaatatgtctgaattatgtaaagtggtgctaataaaggctaatgtgtatat

SEQ ID NO: 7713 - DNA, 324 bp, Diabrotica virgifera
  Clone ID: LIB3026-016-Q1-E1-F10
gtccaaagaaatccacaggaaaacgaggcagaaagcgtaaggacgacgatgactccgatggaagctacagacccattttgatgcactcatagttgattgatcctgtggctgagaaggattattgttatagttcgaaactttagttcatgtttgttgcgtatgctggattattacttacgatgtagatagtgactgttgtcgacttcaaatggcctgtggggatgaaatttataatggatatagtggttttctcataatttttttgtcacgggctcttattcatctcgtggtcgatctaattccttgagtagatcattaagtgga

SEQ ID NO: 7714 - DNA, 466 bp, Diabrotica virgifera
  Clone ID: LIB3026-016-Q1-E1-F4
acggtcgtattccgggtcgcaccagcgtccgcatgacttcatatttttaaacatataacataagcataaaatggcttctaaagcttcttttgtctccgtattgatgttgttggttgctgtagccaatgcttatgatgtaacaaattgtccttcaaataccggtcgccagagaaatcttgtttacgacaatcttttatcgggagtgtctatcaatgttcgtatgccaccggcaggatattttaatagacccataacgtgccttcaactaattgatcgacagggaacctctgtttctccaaagatagtggaaggcggatatctcgatacatacatggtagtcaatattacatcattaaatggtcaagtactttattaccaggcacaaatatatattgattaattaaatttctttaattgaattatatcgttattatatatgtatgtcttagttttaaaacttagtttc

SEQ ID NO: 7715 - DNA, 441 bp, Diabrotica virgifera
  Clone ID: LIB3026-016-Q1-E1-F7
gatgaaattggcaataccagcgggaaatagttgactggtgtacttcatccagttgaaaatattctcggttaggatccattttttgacagacttgctaattttaaaaattcattgtatctgcacatcttgttgtatcgcaatggaactctcgatttatgtcaacaaaagattcaggttacatttttgttgaaggttttattggtggcgccgtctaagcggctatatgtgaaactaaaagacaaacctcgtataaaacaaatactgtttttacagtttatgctgaaagaaaacatgaaataagaatgcttttggaaatttggatattgtgcgccttaaacttctctccaggagtatcagagtataaatactatttcttatatttgttctccaatttttaaaactgtgttacttgttcatttagagattaagatggtacagttt

SEQ ID NO: 7716 - DNA, 418 bp, Diabrotica virgifera
  Clone ID: LIB3026-016-Q1-E1-F9
aaagaaatccaaaggaaaacgaggcagaaagcgtaaggacgacgatgactccgatggaagcgacaaacccagaaagaagcactcaaagaagaaagaacctaaagctaagaaagacgaaggccttagttcgaaacaaaagagcagaattgtttcaaaagctactatatcatctagcgatgatgacagtgacggtggcaaacttcgaatggcaagtggggatgaaagcgaccaaggatatagtggtaaacgcaaaagaaaaatatcttccggctccgactcatctcgtggccgatctaaatccaggagtagatcaagaagtggatctcggtcgaaatcgcggtcgaaatctcgttccaagtcaaaaagtagatcgagatctagatcaaaaagcggatcaagatccaggtctaggtctaaa

SEQ ID NO: 7717 - DNA, 416 bp, Diabrotica virgifera
  Clone ID: LIB3026-016-Q1-E1-G12
acaaaaatttcaactgcagtcaatcgatttctgaattgaaatgaaaattatggcgaatgtacggatacggtgtcgccccctaccaaaaccacttgaaactttagtattttgtttaaggcacaacaaacagaacaataatggtaggaaattagcaatgaatttaatagcaaaaatggcagtttccacattttctaggagttatggatggaaaacgtgaaatttcaacctctcagaagggatgggacgaaattataaaagaactgacagcatcagatgcaggtggtcgatttcaaaggtctgctttgtcagcatctttgacaaatcaaaggattcaattaggtatctctggcaaaagtccccatgacgtttttctaggacgtggtacaatttccttttaaaggaaaatttaatgaaat

SEQ ID NO: 7718 - DNA, 383 bp, Diabrotica virgifera
  Clone ID: LIB3026-016-Q1-E1-G8
cataagcgtccgcaaaaagtcccgccagcctactgaataattagtatggcctctgtatagtgaccgtttcaattaattaagcaaacttatcacggtcaggtgattatttaataaattcagcatttattggttggttaaaaaattaactgtctttatgatccaaatatttagattaaaatataagtttacctgctggatattatcgatattacaataagacactacaaaacttataataaataatgcgaccgctatgttagtataaagtttataaatggtgtaacatcaataatatgaagtcagtacgacttttattaatctacatgatcagaattaaaaccggtgtgagccatgtgagccactatctttgatttattaatata

SEQ ID NO: 7719 - DNA, 143 bp, Diabrotica virgifera
  Clone ID: LIB3026-016-Q1-E1-G9
actagattgactttgatcaacgttttgaattaccaaatcatcaacatttgctataaggaagaaaaactcagtttcaaatactgatgatttggtaattcaaacggtcgagcaatgtcggacgagtaaaaagaaataaggcaaat

SEQ ID NO: 7720 - DNA, 435 bp, Diabrotica virgifera
  Clone ID: LIB3026-016-Q1-E1-H1
cgataagtaacatgtaggtaactactatagtgtgctgtggaattaatttattattagttagtgttacaaagataaattaagtgaaaagatatattctcaaatatggaaaaggcaataatatttacatcagtctctctaatcctcttttctttgtttagtttaggtagttccgtacttaactgttaccagtgtaattccggtactaatcctgagtgtgcagatcttaaagttaatgattacaaatagtacattttacttgccatgtgatgaagactaccatgggaataaaccgttttgcagaatttacgtcacaaacattcagcacgtaaaagatccaaaggacgcaatcagaatttacagaagctgtggctgggaaaactccaaaggcatcaccaaagacctctgcagacacgacgacagtgactttgtgaagaa

SEQ ID NO: 7721 - DNA, 274 bp, Diabrotica virgifera
  Clone ID: LIB3026-016-Q1-E1-H11
cccacgcgtccgcccacgcgtccgagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgt

SEQ ID NO: 7722 - DNA, 432 bp, Diabrotica virgifera
  Clone ID: LIB3026-016-Q1-E1-H7
taccggtctatcacttccgggcgcctgcaatcttctcaaaaattttactatcttatctcaggacatacttcgtgcttgcacgtggtccacttacattctccgccgtttcgagccacacagtgtctcccactactgcggatattgaacctatcataggatcgttaagtgtttcacctattggaccaacactaaattccatcccaagttagctcatcagatggtcagtaggccaactcattcctccatggcataacacgttgaccatcatactatctagtctgtataccacatcgactgccgacagtgtcccgtcttcggagtcagctatcaaggacagtgatggatgatactaggcattcagtaccagctgattccgcatcagtcaactcgcaaatcagctttgccatcgtgtaccacacactgtacatgtat

SEQ ID NO: 7723 - DNA, 311 bp, Diabrotica virgifera
  Clone ID: LIB3026-017-Q1-E1-A12
aaaaaaagtcaggctttatcaacattaagttcaaatacgttaacgaaaaaaaaatttaagcgttacgaccactatagattaactttggtctcagccttaaatgcaatgcttatttcctgcattactatctatgtctgccggttatagaattcacactttaaataatttccagggaatcccttatataggacgttcattaaaacacttacgattgacctgcctttatccaattacgtgaaatccccctttacctggttgtctttttatctctgaattttacccgaatgattgacttatggaaagttcaccct

SEQ ID NO: 7724 - DNA, 390 bp, Diabrotica virgifera
  Clone ID: LIB3026-017-Q1-E1-A6
gaggaaatgtatctccccagatggcttctattatctacagtattctttgtgttgttattactttattagtaacattattcgtagtttctagtttcgggaggaagcctctatactcaaattcctctgtcctatgttccataatactcgctgtaatggctgtgtatttttatttagaacaattcgtgccgacatttgacatatcgactttgagctggctaccaattacatcactagttacctatcaggtttgttcctgtttcggtgtagctataatacctagtattatgctaggagagcttttctcagcaagcgttaagtccaaagctgtagcaacgatgacattcgttaatagtggtgggatattcctagcaaacgctacttttaactttt

SEQ ID NO: 7725 - DNA, 427 bp, Diabrotica virgifera
  Clone ID: LIB3026-017-Q1-E1-C4
ataagtaaagtaaataatatagagtcagtgcaaattaagaggcagagtatctgtaagagtcttaataatcctacctaaaactatttccaaaaatagaacaatttatgggctatctacctcaaacatatcttcatatgtggttaaggctacctccgatgaacctcatcagcgatttcttcaatagttttttattcattaataaaacttttcattatcaaaactaagtacaaacattcactaatataatagctgtgcgattggctttttgtttataaaaccacgtgcggggtggtttttgatttttgaacagtaacgtttgttaactttgtacgttttgcattttatttttattatatctttgtactttatatcttctattcaatcattaaatgtaccatatcagttatctcgagataagccctaaaac

SEQ ID NO: 7726 - DNA, 266 bp, Diabrotica virgifera
  Clone ID: LIB3026-017-Q1-E1-C6
cagtgcaagttcagaggcagagtatctgttcgagtcttattaatcctaccgaaagctatttccagatgtagaacaatttatgggctatctaccgcaaacatatcttcataggtggttaaggcgaccgccgatgaacctcatcagcgatttcttcaatagttcgtgattcactaagacaacttttcattagcagaactatgtacaaacattcactaacacgttagctgtgcgataggcttattgtttattaacccacgttcggcgtg

SEQ ID NO: 7727 - DNA, 246 bp, Diabrotica virgifera
  Clone ID: LIB3026-017-Q1-E1-C7
aattggaatttatgttttaagaaatatacaccaaacgacgtttgaaaagtacatctggtgggcggctttagttgtttatatacttctaatgataggggcacttattgccacaatactgatgtagtttgagccttatacatatatttgatattttatattatacatcattttagtacaaatctttgttttttatcctgtttataaataatgttactgggaaatatgattaaaactaaattatttatt

SEQ ID NO: 7728 - DNA, 430 bp, Diabrotica virgifera
  Clone ID: LIB3026-017-Q1-E1-D3
gccgattttatcgggaagaatttgtaaccgaacattagagagattaaattaaaactgttttagaataaacgcatatgaatccaaaaattgtagattgcctttctaaaacagttttaatttattctctctgatgttcgattgcaggttctttgtgatgggatcggcatcgccgcgctaaggtctctcatgaggactgcattgcctatgttccttatactataaactataaagtcaaggtgaaacggacattagtaaaaatctattcattgaagtagttttaataggacaccctgtgtgtaacaatcatttcctgtatcaggtcattagtagtttattttcgttgaaaatacttgcatagtttaaaagtatgtagcgttttaagaaatcaattgtacattattttttatttgggaaataaaagactcgaagt

SEQ ID NO: 7729 - DNA, 237 bp, Diabrotica virgifera
  Clone ID: LIB3026-017-Q1-E1-D6
acccacgcagatccgaccacgcgtccgatatttttgtatctatgcacgattgtaaataaatatggctgtaaagtgcattcgaataaaattttaatttttgtagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacgaaaaaataaatacaaaaaata

SEQ ID NO: 7730 - DNA, 394 bp, Diabrotica virgifera
  Clone ID: LIB3026-017-Q1-E1-E10
gaaaaaccaattgaaacggctttaataacggaaccattttattcaactatcaaaggtggaaggataagcaaatttcctttgtttatcggtatcaactcagaagaagctctggacagaatcacatattcgtatttcccagggtctgtccaagcgtacgatgctgatgtcaagcagttagtaaatagaaacatgcatatacaagacgatgctaccaaagaaaccatcgggaatgaaattagacgcatttatactgatggacgtttgcaagacaatatggctgctgctataaagtatttcagtgatatgtcatttacacgtccacttattcggcacgcccacatgcagtccatatacagtgacgtttacttctaccaattttcttaacatggacaat

SEQ ID NO: 7731 - DNA, 439 bp, Diabrotica virgifera
  Clone ID: LIB3026-017-Q1-E1-E3
caccacgcgtccgaaccgccggagggaaagcaatgcaccaataaacaatttaaaaacttcgagcgagttcgaactacgaaagtagttagtaggctaggaagtcatgatagcaggccgcactcaaggttgagggtgagcagctcacgttttgggtgcgggctgaaatcatgactgggataattattaacttagtaatagattcttaggtgtagtttggcatgttgtaggtcaatgctgcatgaatgaaggtttgacatcgcatgatgtacaaccttcaaataactctacattagatgattaggacctactattttatagaattagtatttagttaatttgtagttagatattaattataaataaaaaattgtaactgttcaaataaaataaattgttcaaattccggctaggattagattccagatgcctggcctttgtt

SEQ ID NO: 7732 - DNA, 126 bp, Diabrotica virgifera
  Clone ID: LIB3026-017-Q1-E1-E6
cccacgcatccgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacctatttcaaattcccaagg

SEQ ID NO: 7733 - DNA, 433 bp, Diabrotica virgifera
  Clone ID: LIB3026-017-Q1-E1-E7
accacgcgtccgcccacgcgtccgagtaaatcggtacttcagacgattacaacaaatttccataatgaaatccaccagtttttgtgtttctttgtcgatttttgttttgtttgttgttgctcaaaatttacccgtaggttacgctcttgaatgctaccaatgtgaagctaatgctgggataggttgtgaaaaaaactttacatcagttcttcatgaaaactgcacaactggtttttcctgcggtaaaactgtctggaaagttaacgatgtaacaagatatgaaagacgatgcgctgcttcaacatattgcgaggaccaaaaagcaatagcaacaagggaaaacagaacactcgttagttgcagtttgtgtaacgcgacattgtgcaactctggaaatcatgttaacattcctattttcaccttgataatatca

SEQ ID NO: 7734 - DNA, 399 bp, Diabrotica virgifera
  Clone ID: LIB3026-017-Q1-E1-E8
atttttctaaagaacaaaatatggaagattttaaataaagatattttgtgcaaaaaaaaaaaaaaaaaaaaaaatttaaaaaaaaaaaaaaattataaataaaaataaggagtggaacattttcaaagttaaaaataatgttcttacgtataattaatatcattattatccttacttttttctaaattttttacttcaacggggggtctctccctaggtctatttagtaatgtctccttgtattagtattaaacccttgtctatttagtcccccctatttacgtttaggggcggatttctgcaccattttttgcagatagttccctcccatcatgtctttttgtcttaggtataaactctcccctgcccactgatgcttttcactggccggggtatttt

SEQ ID NO: 7735 - DNA, 345 bp, Diabrotica virgifera
  Clone ID: LIB3026-017-Q1-E1-F1
acgcgtccgaaaaaaaaaaaaaaaaaaaaaaaaaaaaaaaaaaaaaaaaaaaaaaaaaaaaacaaaaaaaaaaaaaaaaaaaaaaaaaaaaaaaaagggggccgcactaaaggaaaaagggggcccttctaagggtttcatacttcttctcccttctacgcggtctccaaattccttttcattggcccccctttttaaatcccggggctgcgatttccccgctctttcccgggaaaacccccttgtttcccaactctcttcccctaccaggcttcccccttttcacgactgcccctttccccaatcggcccacttctttagccccttccgaaatttttccccccc

SEQ ID NO: 7736 - DNA, 366 bp, Diabrotica virgifera
  Clone ID: LIB3026-017-Q1-E1-F12
aataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtaaatttaataaaaatatataagtttaataaaagaattcggcaacatttttttcaaccgtttaataaaaaacattccttttggaataaataaaaa

SEQ ID NO: 7737 - DNA, 387 bp, Diabrotica virgifera
  Clone ID: LIB3026-017-Q1-E1-F2
attctttacaagcaagtagaaagaacggtggtaccattatgtgttttcatcaccctagttaaagcacggagttgctttcattttagtatttttgatccagtttaatgaactagaagacaaatcatttgaaatatttttgttcgagtacctaagtgctaatttatttagacaatgctgaatttttctatataaatttttcttatgaactatggtttcatgaaatatgtactgttgctgtatctatgaatattgtgaagtgacttttgtgcagtgatatcgcgtcttggacttaacagcacccacaaaacgattcaaggacaatgattacacggtatttttttatgtagaacctttctttcagttatttgtttggtaatcccgatctca

SEQ ID NO: 7738 - DNA, 417 bp, Diabrotica virgifera
  Clone ID: LIB3026-017-Q1-E1-G10
gggtcagcaccgtcgaatttaacaagataaatacttgggtggtaaggtagtaacaagggggcataacaacattggaaaattgagttttaatttagttgtcaataattttaagtacaattttgattattataaattaaaatatgagcgaaagtgaatttgaagaatttgaacgggcttgggaagaagggtgttccgcaattattcccgaaaaatcgaaaatccgttatcaaaatacctaccaaagttttaaaaaatggtgcgaaggcaagaatttaagaatcgaagaaaagactctattggcatatttcgttcaaagacatatgcagttgaaagctcctggaagcctctgggcagaatattcaatgattaaatccaccatttttctttatgacggcattgatatttccagtttttcac

SEQ ID NO: 7739 - DNA, 350 bp, Diabrotica virgifera
  Clone ID: LIB3026-017-Q1-E1-G12
ctgtgtgataattgcattgccttggattacaccaaggagtaaaggataaatcaaccaaatctggcctgtttaagtaacaacttgtattgggatatattcgatatttggctcacaggttttatccttattgaaataccactaaagttgtttagaacaacaataatatgattggtacttattggagtcacagtgtgatctaatttgtctttattttcttggaaacatatcccacgaattcccaatgattctggttttattcctttcaatcatttgtctgggaaaccattgttagaacttagtttttccattgaaaatattttaaaaagctatttgtcatttaccggtacttt

SEQ ID NO: 7740 - DNA, 297 bp, Diabrotica virgifera
  Clone ID: LIB3026-017-Q1-E1-G7
cccacgcatccgagaatttaaagttttaattcgttatgtaatgttataatgatcattattcataaataattataacgagaggggattgttcataatcgatatgggaggatcacgccccgttataattatttatgaataacgattattatgagattacatataggatttaacgttttaattgggaattataaatgccagggaagaacattaattttgatcacaccatttagattaattttattcaatgaatttcctggattatacgcgtatatgtatactgtattaagacatttagct

SEQ ID NO: 7741 - DNA, 450 bp, Diabrotica virgifera
  Clone ID: LIB3026-017-Q1-E1-H1
gcggtcctacattcacggggtcacgcacgcgtccgccatcatttaattggtagtccgatggaagaattcgatgaaatggatgaattagaagaggaaatgttggatgatgaagaaggggaagaaggagccgaggaagatgaggatgaagatgaacccaaagccaaaaaagcaaaatcagcgactaacgccaagggcaaaactcccgtaaaaaacaattcaaaggctgcaaagaaataaacaagttcatctaatccccaaaccacctcctttgtaatgttaagttagttttttaatgtatctcgggagttgttatacatccattaacagattaaccgtaacaatttctcttaaatataagtataatattttatgtttcttgacgtcataagattttgtgaaagtttcttttattccaggtgtaactcttagttttaatgtgatcaatatttt

SEQ ID NO: 7742 - DNA, 289 bp, Diabrotica virgifera
  Clone ID: LIB3026-017-Q1-E1-H6
aaaaatggcaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgt

SEQ ID NO: 7743 - DNA, 399 bp, Diabrotica virgifera
  unsure (1)..(399): unsure at all n locations
  Clone ID: LIB3026-017-Q1-E1-H9
accacgcgtccggtgtctcaacatacacttgaggataatttccacccaaaatacggaattttggccaattgacatacccattcaaccaaaattgaccttcatcaaaattcgcttataaaaatcgggatcaacggcaatctcgttttgggccctttcgccttatctacgccttgctaggtaatcgtgtagcttcaattcttgcacgagttggattttgtatcttccataaagtggatggacacataatcaactgctgtgcacgatgacggatataatgattcgggtcttcctctatgttacgctatacaatagcaacaacttcttctgtacgacgtctctgtggatgcgtattatcaaatcttgacatttcccattaattttgaggaaacaanaaaaata

SEQ ID NO: 7744 - DNA, 406 bp, Diabrotica virgifera
  Clone ID: LIB3026-018-Q1-E1-A10
aaatagaaactgagcggaaaggagtaaattggaaaaaaagaaaggttttggctgaaaagtaaccaaagttaaaataataataaaaaatatttggcaatattcgttgcagaagaaggtatggaaggtgcataaataaaataaaaattaaattcaaatatttttttatatatttgtgacataggtacttatgtgtttacttttgctgtttttttgttcggtaggcacatgtgaaggaattttcagaacgatctaaacttattatataattattttacatataaaatgaagaaactccttcatgtctgtttacctatgtaaattatatatatattctcggtctctttgtagatttttgtagagctttgtttctttctgcttttacatattaactggaataaataataat

SEQ ID NO: 7745 - DNA, 355 bp, Diabrotica virgifera
  Clone ID: LIB3026-018-Q1-E1-A8
tcccggctcgacaaacgcgtacgcgaatttaaaagagctaaaaaattaaaatttttattgtaaaataaatattttaaataatttttttgtaatgaaatgttattcgtttttaaatatatcgaattttttaagaaataaattaaatttattgattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattagtatttttattttttacaaattttttagtaagatataaatt

SEQ ID NO: 7746 - DNA, 304 bp, Diabrotica virgifera
  Clone ID: LIB3026-018-Q1-E1-B6
acggaaaaggcaacaaagatcatgcatagcattgctagtctagcacagaaggaatatagaatttcgttccgacagatgagaatatacctaagtacaatacttgcatcaattgtagggtacggttcaagtgtatgggcacatagactaataaaaaaaaaaaaaaaaaaaaaatacaaaaaaaaaaaaaacaaaagaataaaaatttgtagtgtcccaataaagattttacttaatttttttgtaatgcaatgttaatcgtttacaaaaatttcaccattttcaattcattggccatctttattca

SEQ ID NO: 7747 - DNA, 361 bp, Diabrotica virgifera
  Clone ID: LIB3026-018-Q1-E1-B7
acgatgatttgtttacttgtgtttttgaaccttgaagatcgtcgttttgcgattttttttttcatttttaaattgttcattactcggaaatgattaactttggaggaaaattacacaagtccttttttgttctcaatgataaaaagaatctaaaataaaatctactcgcgctgaaaaatttgattttttataatttgtttaatttttttttaataaatgtagcaataatttcgaaattatggcattcaggtatagggaatataatatgaaaagtaatcagtgtttcttggggacttcaaaacgcaaaaagtatgcagggtgttccatttaaaataagaaagttcattggatttacagaaaa

SEQ ID NO: 7748 - DNA, 354 bp, Diabrotica virgifera
  Clone ID: LIB3026-018-Q1-E1-B8
acggattacgcataatatcgttgtagataagctttttgggatatacaatttcaattttgcaataagtattacctaagtgaaacttctcgaaatttttatagttgaatctttgtgatattgtccttattctcacgcaaaattcaggttttttgtgtatttttaaaaaagtttttaataatatccaaaaaatcgacttttgaagtcatttttgaaataattattaagcaacaaattaacaaaaatacctttccaaacaaccgttttaaagaattttctgtaccttttcagtaaaattttatcacatttccatataatttaccagtcttcaccttcagtatttaaaatcaaataacg

SEQ ID NO: 7749 - DNA, 335 bp, Diabrotica virgifera
  Clone ID: LIB3026-018-Q1-E1-C1
acgaccgtatttcgaaagttctgcgaacctttggcaacaatgcgttggcagtacgtgacactttcaaagacgaaggcacaatattggatattgtgataataatatgttgtaaaatcagtgagttaagttcgatttcttgttatacattatagataatcgattttagtagttccaatgtgacacaatatctaggcatgagataaagtttatttgaagaaagtgtttttttttgttcttcttaatggcggtacagactcgtttttgtaatattttatttaattatagagtatctccacatactaacatatttctcaaaataggctctgtaccgccat

SEQ ID NO: 7750 - DNA, 195 bp, Diabrotica virgifera
  Clone ID: LIB3026-018-Q1-E1-C2
gacgcacgcgtaagcacgtatcacttgatatctgctcgcctatagcaacacagctgttgaaatacgtgacactttcaaaaacaagtgtaccaccggtgtcatggcgtacctgttgggtgcgtcagacagtttcattagtacaatatcggttcgtaggtgttatgtaatccatatgtgtctcatcgcggttgactc

SEQ ID NO: 7751 - DNA, 320 bp, Diabrotica virgifera
  Clone ID: LIB3026-018-Q1-E1-C7
acgctcatttcgtcagcccacgcgtccgttttaatttatattaaaagtatagaatatttttaattaatggtagttaaatattttagttaagagataattaaatatttaatgtgagagaatattattttttgaaccttgagtaacataggattatgtaccttgtagttcaaggataataatttcgaatttataagatcaatattttcaaattttttagtgctaaataattattatatttaatgtatttgaaatgtaatgttaaacgtttttgtatagaactgttattcgaatataaatatatctattatttaacgacatta

SEQ ID NO: 7752 - DNA, 376 bp, Diabrotica virgifera
  Clone ID: LIB3026-018-Q1-E1-D1
acgaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttacaatatgttattatttatttttatatattattatttttaattttttatacattttttattaaaaatataaaatttaaattatttaaatttagtaatgatgataatattagtattaaaaa

SEQ ID NO: 7753 - DNA, 379 bp, Diabrotica virgifera
  Clone ID: LIB3026-018-Q1-E1-D11
agattcactttactttcactccaacagaagttttttattttgttacatcggcagcccaatgcggtgccaagcttataagttctaagacagtagttcttttagtctttttagtagctatatctgaactgttgggcgtacgacccttttaaagaaactgttgccgtacatacagccaccgacatctatgagaagctcctgacactcaattttaatgctggcccttataacctttcttaggacgacaagctgggaccttagaacattcctccgtcaataactgaatgacaccttgattatttctaatttccacttaattctaaagtatcttctatctatcaaaagtcattaatggcatgcaaaggacttaaaaggaaagaat

SEQ ID NO: 7754 - DNA, 374 bp, Diabrotica virgifera
  unsure (1)..(374): unsure at all n locations
  Clone ID: LIB3026-018-Q1-E1-D7
acgcccacgcgtccgcccacgcgtccgtgcagtattaatattggttaccctttcaccatccagtgcagataattataacaaatgtccagaaaccagccatgaacgatacctaatttaccagaatactttaaaggggagagttatccatgtacgcattccaggaacgggtttctttcacgctccaatcacttgtcttcaggtaaccgacataaatgagagttttagtacaccagttatagaagaaggtggatatggaaaggagtatgtagttttacgaattgacccagttcaatcaggagaacaactgcagtacgatgttcagatttatgttgaccaataatcaagttanctttaaataaattttttgggccgtg

SEQ ID NO: 7755 - DNA, 242 bp, Diabrotica virgifera
  Clone ID: LIB3026-018-Q1-E1-E1
agctgatagtcggttgagcatcattacctgatttatatttcagagtcacctgaaaaatctacataggtatatattatattttctaaaatgaggcacaagcgaaatattttacagttcaaatatattttgtcacaaaatcaataattctgatttcaattgtaaattttgcacactctgtacaaaaataagttgatttaaaccacaaaatatacaatttgctattgcaaataaagtgaattcac

SEQ ID NO: 7756 - DNA, 262 bp, Diabrotica virgifera
  Clone ID: LIB3026-018-Q1-E1-E10
agagttgatgctgcgattactaaagataatgttaaagtaacttttaatggattccttacagtcatgctgctttaaagatgaatctgaaatattggtactatactaatattagtatactaccaatattagtatagtaccaatattggtagtatactaatatgaattataaacggtacacttcaaacgtcacaaatcgagtacatcattatttaattaaaaatactgtgtctatatttttgtaaataaaattgttttttttaat

SEQ ID NO: 7757 - DNA, 197 bp, Diabrotica virgifera
  Clone ID: LIB3026-018-Q1-E1-E11
agcgtatacatccggatcgaactttttgtcccatatgttaaatttaatgagcctgagcatgtctatgaggtgcaatatcttgaatgcgaaaatgtagatatttggaaggatgtgctaccaacacaagttttaccacaattcactttttcatggccagccaagtcagattcctatcacacatttcagaaggttgaccc

SEQ ID NO: 7758 - DNA, 74 bp, Diabrotica virgifera
  Clone ID: LIB3026-018-Q1-E1-E2
aattcacggctcgacgacgcgtcagctgctaatcagatgatcaccatgacaagagctacatttctattgcacct

SEQ ID NO: 7759 - DNA, 321 bp, Diabrotica virgifera
  Clone ID: LIB3026-018-Q1-E1-E3
agcccacacgtccgcggacgcgtgggggtaacccaggtgctgtacagtttggaaattttataaattactatcaattccattctccagatgatcgcatcactttattacccaaatatatttgggaccaacataaaccccttgttgctttggatattggctgtaacactgggaatctaactatagctttaaaggacttcttagaggaacatgtttcaaaagatacttcagtactggctgtagatattgatcctgtattaatagatcgagcaaaggatgttaaaaccaataatataaaatttgaatgtttagatataatggatg

SEQ ID NO: 7760 - DNA, 378 bp, Diabrotica virgifera
  Clone ID: LIB3026-018-Q1-E1-E4
aggttttatacttctagtcatattcaaagaccatgttcaatgtttaccgtctgcgctattttccaattgataattagtacttgacgccatctttcaacaagtctattgacaaatttacaaaagtagcatacgttgcacgatggtatcaaaattaaaagagctcactgccatggcgaccgttccgtaacacgttccgcaagtagcaccacatttatagaacgaatttccaaccgttgcggagccgctccgtcactttttcgtctcttgaatgcgacaaatgtaacactacgtagtaagtattttgtcaatgtttcttaaatgttgtggttatagctaaaccatctcaaatgggcaaaaaaattaatccgggaaccaaat

SEQ ID NO: 7761 - DNA, 349 bp, Diabrotica virgifera
  Clone ID: LIB3026-018-Q1-E1-E6
acgctaactttgtctaccctcatcgacggcaagaacttcaatcaatgtggtcacaagattggtttggccttggacctgaaggcttaaatatgttattacatcttgttccacaaatacatattagcgcccatttaatatatttaataatcctgtattgtatataataattatttaaacgggactttagtgttatactttattactcccgttgtgtttatttcacttgctcctcgcaattaatccttttttacacgctacacgtaaatactgtttttactattaaactctgacaggcacacttttctggatattttcaaagattgatgtcaagttaagaccatatgcattt

SEQ ID NO: 7762 - DNA, 292 bp, Diabrotica virgifera
  Clone ID: LIB3026-018-Q1-E1-E7
acgcaaaatggcaaaaatcaccttcgttcttttggctgtagtagcagttgtggtcttggcaacagctgaggccagccccaaggcagctcatggagtaagtgtctttaaagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgt

SEQ ID NO: 7763 - DNA, 375 bp, Diabrotica virgifera
  Clone ID: LIB3026-018-Q1-E1-E9
aggagaaacttcgtgaaaaatgagtgtgcagaaatacggaacggaatacttgagaagttatcccggcttacttaaagtctgtgaacaggtgttgaacatcagcgtaatcatagcaggatcaatttgtggatttttatttaaaacgatccttctaaacttcaacgctatatatgctttatgtaccaccttattcttccttattgtacattacaaagcgttgtttagaaaatcgacttttccgtgggactggatagaatgcgccaacagtctggcagtcgctgtcgtttatgcactaggtgcatcaattacgctctctgaattgtccaaggaatatatagttgcaggaatcattggatacatccactgcaatggcgt

SEQ ID NO: 7764 - DNA, 339 bp, Diabrotica virgifera
  Clone ID: LIB3026-018-Q1-E1-F2
acgatcatacatttattattttcgaatttatcagagctacaaaattagcatttttatcgcaaaataaaaattttaaacacattttttgaaatgaaatgtgaatcgtatttaaatacagcgaattttttaagaaataaattaaatttacattactaacaatatatctagaattaaatactcttatatcattaatattaaatatttttacggatgaccttactaataatatttcaggatgatttaaattttaaacatcaattatgagtaacaattttcatactttaaaagatgtcaccacttaattctatagattagcatctgcatcctttacaagttttt

SEQ ID NO: 7765 - DNA, 380 bp, Diabrotica virgifera
  Clone ID: LIB3026-018-Q1-E1-F6
acgcccacgcgtccgtaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttttcacctgtttaataaaaacaagtcctttt

SEQ ID NO: 7766 - DNA, 382 bp, Diabrotica virgifera
  Clone ID: LIB3026-018-Q1-E1-F8
gtgcaaaggatattcattatacacagtatattgatatagaggtagcatttttggagtacgcatacacaaatgatcgtgatgcgttcaaattagaagctaccgagttgatgaaacgagcatgtgatggcatccgcttatggaattataaacgggattttgaaaattctaagttgaaatatgaactctttctagaattagtgtcagtgtttcttaaagaggtaccatcaagatctgactgttacaaagatgttcaagcttgtttaataattgaattggttgatttgtccaaagaatatccccaaaaatgtattaatatatcagactatccagaatttatgtctgtcattgaaaccatgttgaccaaaaattaaaaattttaggt

SEQ ID NO: 7767 - DNA, 276 bp, Diabrotica virgifera
  Clone ID: LIB3026-018-Q1-E1-G11
agggatacgtcaggaataaacttttataagcatcgaatttttatagcctaatcatgaataaaacatttcacctgataaaaggcgagaatattaacttataaaaaatattgatttaattatttaaaaatctattctaaaaatctaaattcaaataacttaaaattagtatagatgataatattataaataaaacattgaataattaatttaaattcatatgtttaataaaggaaatcggcaacatttaattcaccagcctaaagtggaatagtcccg

SEQ ID NO: 7768 - DNA, 374 bp, Diabrotica virgifera
  Clone ID: LIB3026-018-Q1-E1-G12
aggttttaataattaatgtaattaaaaatagttagtatatttttgaaataaaacaactgccgcaacaaattagggagaatacttttgtctcctgtagttttatctgttatccaaagttcgattaaattgtttcaatttaatgtatttttccatataacgcaccaaatagtcttaaaaaaatagtgcctgttactacctaatactttctacgtatgccttatggttagtagtggctccaataggtgcattttacatttttcatgaaaattcaatttacattattttcctcccgttctcttcatattatatttatttattctttaatatagttttgggcgtgaagcccagtaaatacctatatgaagtatattgat

SEQ ID NO: 7769 - DNA, 375 bp, Diabrotica virgifera
  unsure (1)..(375): unsure at all n locations
  Clone ID: LIB3026-018-Q1-E1-G5
acgcgattatatttctttcggattgttggcatttaggaaacgtaagaatattctgattacttttttcatgtttcgtcatcctaattatttattcccctttattcgccaattattttatgtaattatatattctagttactgtaatcagttacagtttttatttactgaagtcttgataaaccttcgataaaacgtggattataattgcttcccagcatcaagccagtcgtgaaataaagccatcttgatccaactttacttacagaaaattggccagaagcatttatttactataaggggcctaccatttaatggatttattggtaaagctggttctttcaatctaaaacgaatgggctancgtacattaatttt

SEQ ID NO: 7770 - DNA, 296 bp, Diabrotica virgifera
  Clone ID: LIB3026-018-Q1-E1-G6
acgaaaactaataacaaaaatgtttgtccctaagatgctcttggtcttgggctttgcccttttagcctcagctggaaaagaccttgattatggcatggaagttttgagatgcgccaacagagcattgagaccaggagtaccggaattgggagttccacaacatgatcgcttcgtcgcctttagtacgaacatatcatggcatggagacatcggtgttgctagcacctcaatcgaaatccacacatttgaatggtatggtcttgccgactggaacgttactgctaagcaaatcaatg

SEQ ID NO: 7771 - DNA, 278 bp, Diabrotica virgifera
  Clone ID: LIB3026-018-Q1-E1-G7
acgcaaaaaatataaatgtttaattattaattaatatgtgtgttatagaacacattcagtattaaaccagaaactgtttgttttatttgtcatgatatttagagatattatatatcagatataatacatattattcatcattcctaccccttttttagttgctaatataacatttctttctacaattttttgtttgtagtgcgtatgtaaacatgtaaatgtaatatatctattagtccaataaaaatattctaaagtaatgccaacagaaacattaa

SEQ ID NO: 7772 - DNA, 389 bp, Diabrotica virgifera
  Clone ID: LIB3026-018-Q1-E1-G8
acgcaaacatgaagacttccattgttttagctattttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaacaataaaaaaaaaaaaaagggcggccg

SEQ ID NO: 7773 - DNA, 337 bp, Diabrotica virgifera
  Clone ID: LIB3026-018-Q1-E1-H1
acggcaaaatataaaaatgaagcaaatacttattctttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggt

SEQ ID NO: 7774 - DNA, 397 bp, Diabrotica virgifera
  Clone ID: LIB3026-018-Q1-E1-H11
gggctacgtcttggttaaacaatctagttgaatgacgtgaaaatattatttttggagctttggtacaatagaaacttttttgttccggttgttttagtattaaacgtattataaatacagattctgttatttttgctcaatttttttgtttatctaatccgatttaaaatgataatattgcatggaacatttttcaaatagagatctttatattttttgaacaaactttgttgtcgaaatgacaagagtaggaaaaatttagaaatatacgacaaacgttttattttttataaaatattttgtaaatttttcctcttttcggaagacctactttagttagtcgtagacgtagtttttaaatgacaccctgtaaattgtacattgtatatagaccttg

SEQ ID NO: 7775 - DNA, 355 bp, Diabrotica virgifera
  Clone ID: LIB3026-018-Q1-E1-H5
acgcggacgcgtgggcttttttacaatttgtgctgttatatcctctatttttctcgactcttctctatctttcattctcatttatttcttattaatttctctaaacatcattttcaaatgtgcactgtatcatatcttcggtatagcatttcatcttttttctggtcttgaacgatttattatttattcgtttctttcttaatatgtcacataatctacctattctctatgatttctctacacttttctcctccacttcttgcaatgagagattgaacagatacttacacccttttatagctgtgcttttttctgtcgttgctgagattcatcgcctttactaaccacttcattt

SEQ ID NO: 7776 - DNA, 364 bp, Diabrotica virgifera
  Clone ID: LIB3026-018-Q1-E1-H6
cgcgtacgcccacgcgtccgtgcggattattacccaaatggtggaaagaaccaccaacctggctgcgaaatggacgtgctcggtaattgtgcccatttcttatccattaagttctatattgaatcgatattaacgggtaacttcaaggccagaaaatgcggctcgtatgacgacttcactaaaggaaagtgcaacgattcgccaatttcatatatggggcaatataaagttgacaaaggggcacagggatcatatttcctccaaaccaataggaagccaccatatgctaaaatttaatgtgattaaatgtatattttgtatagaattaattaatcctttaactccttggtaaaaaaataaatta

SEQ ID NO: 7777 - DNA, 327 bp, Diabrotica virgifera
  Clone ID: LIB3026-018-Q1-E1-H8
cggacgcgtgggctgtgatatacgaggcactagaaattgcgtcttgatttgtgttaggtcactcgtgataactttttagatattttatgaattatttatatgttctatctttagtatagtacgtatccgttttcatcgggaacgcattttaaaagataattggccataatgaaccacttccgattaacctggtaaaccccaaggtaaaagggaaattggggtgaatggccaatttgaaattgcaatttaattaacattaactaatggaaaaaattgccaatttttcaatttggtggcctttaaaggtttggtttggtggcttacttt

SEQ ID NO: 7778 - DNA, 374 bp, Diabrotica virgifera
  Clone ID: LIB3026-019-Q1-E1-A3
gtcagtcttgtataaaaatggtgttatttaacttgaaggattgccaggattatgtttataaacacataggcttttataaaagttgtcctattgtgtgactactttttattatgaatttttgcattatttatcccctttatttcccccatattttttcctgactcgaacattaatctgtatcatttacattttttattatcaaactgatttcatttatatacatgatatttcaatcatttgaaataaatacctacgtaatatatgtaagtattacgaaatctaatatttgtttgtactgatagtttaatttctgagatttatgtgattaatccttgtaattaatattattattagcattagtatcagttttcgtg

SEQ ID NO: 7779 - DNA, 327 bp, Diabrotica virgifera
  Clone ID: LIB3026-019-Q1-E1-A8
cggacgcgtgggagaacccctcagttatcaagtacttctggattgatccgtatcatacggaattggggattgccatgaaggtggacttatgaaccttgcttttggtttcgtctacgatcacagaatcgtatcggaagcaagttatccctacaacactatctaccgacattgaagtccacccaatgttagttcagtatttcatatgcaccgttactgtgacttatagctagctgatcaaactttgtgacatgccgtcagtactgttagtcccatttctgcagctatttgggtctgatcaaatccacttctatgcaagctgtatatatc

SEQ ID NO: 7780 - DNA, 405 bp, Diabrotica virgifera
  Clone ID: LIB3026-019-Q1-E1-B12
agggacagcccctgcttacagactcgctcgatctaacatctccgtcaattctttcaaagattcggcgaaaagcgttgtgccttttatctgtgtacctactttaagtagatacttacgattaagcaatacgtagttattagaatacctaaatgtttacatttatatttttgatctaactttaaccctctaatctacagaaacctaaaatgaaacagttgaattgttttacaaatgaaaaatatctattttaactatagtagggacataaaaatgctgttaaccgatttcaaatggggtaaatttagtaaatcttagcctttgtgtatttaaaacttacactagagatatatgttaactgcgctacccttgatgggatcaaaagatataagtttggaaaaaataaac

SEQ ID NO: 7781 - DNA, 448 bp, Diabrotica virgifera
  unsure (1)..(448): unsure at all n locations
  Clone ID: LIB3026-019-Q1-E1-B4
ggtctagaattaccgggctanaactaactgcaaagtataaaaatgaagcaaatacttatcctttcaattgtgtgcgtacttgcagtccaattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtaaagggcatggcttggaatacaacgttaccatttatgctaaataatgttattgaggtgtttaaagagtttgtgtgattataaaa

SEQ ID NO: 7782 - DNA, 268 bp, Diabrotica virgifera
  Clone ID: LIB3026-019-Q1-E1-B7
caaaacataaacataagtaacaagtgtgaacacaacaacttcagaagtacttgtatctaaaaatgtttctcagcccctaaacattactgtgaacaacgccccaaaagttgtgaacaccacctcaaaattcgtaaactcttccacccaattaactactaatcatacttcagttacaacaagggcaactaacacatcaataacaataaaccaaaaaaacccttaatttacggaacacaacaaattggtggtacctcaaccaaaaccgaac

SEQ ID NO: 7783 - DNA, 398 bp, Diabrotica virgifera
  Clone ID: LIB3026-019-Q1-E1-C10
agcagaatatttgtcataatactaaaagatttttaatatagatctcttttataattaattttgggaatagttaatgaaatatttctttttaaaatacttttgtaactttgtatttaaagttgggatgtatttgttaaatacaattagattattgggttggggttttatttttatcttctaatatttgtgaatgttattagataaaaattgtaatggccaactttggtgtgtaagcaagggggcagcttaaagcttttcgataatgaataaatgttttttgttaatatagttcctaatgtattttcgtcaaatttaatttgagtaaatagactaggatatatatttattcgctgtttagatttagattattgctgcatagaattaaataacttaagggt

SEQ ID NO: 7784 - DNA, 81 bp, Diabrotica virgifera
  Clone ID: LIB3026-019-Q1-E1-C11
aggcccttttttttttttttttttttttttttttttttttttttttttttttttttttttttaaagttcaattattttaag

SEQ ID NO: 7785 - DNA, 281 bp, Diabrotica virgifera
  Clone ID: LIB3026-019-Q1-E1-C7
cgacccaagcgtcaacctacgcctccgttaaaatccccaacacagcttcagcccatgttgctctggcaatactggatccttaagtgcaactcccagacattgtattcatcaacaagggtccaaaagcagatggaacaactactcgggagttgggattctgccagtcggccctacgcagggattactacggaccaccaacacacccgagtattacttgccgcatcacttatatattagataaactgggttgatccaattgccacctcaggttctcatggtcg

SEQ ID NO: 7786 - DNA, 371 bp, Diabrotica virgifera
  Clone ID: LIB3026-019-Q1-E1-C9
aggaaatcttctattcacggttgattattttccaaggaggctatatatgaatttttaagaaatttgtcttaaggtaaaggcacttactgctcctgtaaagggccaacagcttctataaatatttaaaatcgtaccttgggatggcattgatggtgtgcttccatatgaagaggatattgatctctccgatgtagatttagatgagatagcatagttgtaaatgtcataattttatatttatgtatcaattcctgctgttaaagtttgggttaaatcaatttccagaatgtaaattttttaatcataaccaattgatttgctaaatttgtaattctgatctcaaatgctttatcttatttaaaattggtgta

SEQ ID NO: 7787 - DNA, 352 bp, Diabrotica virgifera
  Clone ID: LIB3026-019-Q1-E1-D1
agcccacgcgtccggcaagagtatacaattgggatgtcaaaaggcgccaagcattaaaagcaacagcagcaaaataatacagagacgtttttgatagaggccaatataataattgcattttctcattaaattattttatttttattaataaattaatatttaccatcattgtaatctacatccaagcccttgatttcaaattggctgccacagaagaacgattttgtttcttaagtattaaaaatcaaataataattaatgtgatctgtatttctcaagacatgtgacatcaattgcactatattttaattattttctttgcttatttatagttaatttcatttttattatt

SEQ ID NO: 7788 - DNA, 52 bp, Diabrotica virgifera
  Clone ID: LIB3026-019-Q1-E1-D12
tgtgagatgttttaaaatttatgtttagtaataaatgttactcacctctctg

SEQ ID NO: 7789 - DNA, 372 bp, Diabrotica virgifera
  Clone ID: LIB3026-019-Q1-E1-E10
cgatcaaacgtcaggaaaaagagtaccttagcttatggttagtgatgtccgaaatcaggaacagatattgtgccgttcatgagatcgttcttaaaaatcgcgacaaaattaagaagcctagaccctcaaatgctaccgaatctttgtactagaatcaataaaaattcattctgtcatatgaaatttatttgtaaacattaactagttggagtatatctggcgcgtatggaagtttttctaaaagtaaacatattttcttaagatttgagttgacatttttcatgtatattatttttgtcttagggtagttgttcaccaaacttttttgacaataaaaatagggcggaagagagggaaaagaaaaagggcggc

SEQ ID NO: 7790 - DNA, 416 bp, Diabrotica virgifera
  Clone ID: LIB3026-019-Q1-E1-E12
agaaatttcaccggccatccatctcaccctgttcagttaccaccacctcattttgcgaatatgcccaataatttgacaccaaacaatcaccaacttccccaaatgcagatgggcaacaacgggatagacgatactttgaggtcacctgaagaaacgcttcagattggcaaagacggaggagcaccaccaaacagaggtccaccaaggcctaacaacaaccagtcttactaccaaaacaacggttacaataggccacgacagcaaaaccagaataggaacgctagtggacctaggcctactgctactagacatgcataatactaaagcaacattattcggtttaaccctaaacaaggatattaagtaacaccctgtaaggtattttttttaataaaagttaaatcatagtacgaacg

SEQ ID NO: 7791 - DNA, 440 bp, Diabrotica virgifera
  Clone ID: LIB3026-019-Q1-E1-E3
tacgcgtccaggtgacggtcaggaattaccgggcaagagctacgagattacaggaacagggtatctattttacaagaaaagtcaatagatgaaagacttcaagctgaaattgttgtcaacaagacaaagagagagaaacaacccaactctcaacagaaattactaaagggtgttgttataaagaaacctgaaaatcagaaaaggaaaatagatgaggttgataatagtgaagaaacaaatgtaaagaaacagaagaaccctgaaaatcagaagaagaaaatagatgaggttgataatagtgacgaaacaaatgtaaagaaacagaagaaacctgaaaatcagaagaggaaaatagatgagatagataatagtgaggaaacaaatgtaaaggaacaagcaattattgatgtagatgataagtcaactaaaaatacacaaac

SEQ ID NO: 7792 - DNA, 424 bp, Diabrotica virgifera
  Clone ID: LIB3026-019-Q1-E1-E4
gaattcacgggcaagaactacgatgaaatacaggaacagggatatctatatttacaagtaaaagtcaatagatgaaagacttcaagctgaaattgttgtcaacaagacaaagagagagaaacaacccaactctcaacagagattactaaagggtgttgatataaagaaacctgaatatcagaaaaggaaaatagatgaggttgataatagtgaagaaacaaatgtaaagaaacagaagaaccctgaaaatcagaagaagaaaatagatgaggttgataatagtgacgaaacaaatgtaaagaaacagaagaaacctgaaaatcagaagaggaaaatagatgagatagataataatgaggaaacaaatgtaaaggaacaagcaattattgatgtagatgataagtcaactagaaatacacaaact

SEQ ID NO: 7793 - DNA, 260 bp, Diabrotica virgifera
  Clone ID: LIB3026-019-Q1-E1-E5
aggttttgcctacttttctggaatttcagcgaagtttggggattaatgacgttattaactgtttcgctgagtgtttagcagtaagaaaaaacctgctggaaaatagtgatattattgatgatgatgccgttattgttcttgagaatctaatacctaaaggttattacaataacgaaagggtcaaagggatccaatttgataataagaaaattaatccgaaagaaaatggccaatttaaaggcgttggcttaaccccgaaa

SEQ ID NO: 7794 - DNA, 355 bp, Diabrotica virgifera
  Clone ID: LIB3026-019-Q1-E1-E6
aggttatgcctacgtttatgcgatacttcacacacgtcttggcgatcaacgagtttggtaccaggttccctgagtgtttaacaataagaaaacatgtgctggaagatattcacattattgctgaggatgccgtcattgttacctgaaatctaagactcaatggttataacattagctagaggttcaaaggatacgatttccatactgacctgtttattctgatgcatattgccaagttacatgccagtacttcatctcagacattaatcgatcctaatacatttgacgaccaggtcaaaaagtactgccatgtgtataaatttccaaaggatcataataccaataatggattttt

SEQ ID NO: 7795 - DNA, 407 bp, Diabrotica virgifera
  Clone ID: LIB3026-019-Q1-E1-F1
agaataatcgaaattcccagtattatttagtaatttaacaactatttatacatttcagcaaaaacttgatacattattgtagacaacagtgatccgcgtttacttaagaccaaaaatgttttttttgcccataatacaatcaaatttttttcgagaaccacttaataaaatgaaatttatttttggaactcttagaccactcatgatcttcagagatgtattcgaaacaccgcagttagtaatccatatgtttttttatttaaatttaaccgagttattaaacgagaatattatggcgaaaatgtttttatctgtcaaacttatcctttcgttatcaatgactgccaaaaatttttctttattaaatgattgttgaaaaaataaattacatgtgtagtatgtttttt

SEQ ID NO: 7796 - DNA, 189 bp, Diabrotica virgifera
  Clone ID: LIB3026-019-Q1-E1-F12
agcccacgcgtccgattagatcgcaggcgataaacgctttttggagtctaccaagtgactccaaaaagatatagcagtcatctactagacctgtacaagctgctacaaggtaccagaatcctagaataggtatcacgaatgaatggaacatgtacaataagcctattgactgcattaaaaaaaaagaaa

SEQ ID NO: 7797 - DNA, 419 bp, Diabrotica virgifera
  Clone ID: LIB3026-019-Q1-E1-F5
agcccacgcgtccgaacaatggcatccaaaactgttcttttcggactcttggtagtccttttggtcaaccactctttggctagagatctgactgtctgccccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccaaagcgatagcgtacctgaagtagaagatggtggtgttgacagtacatgggtgaccgtaaacattgctcccgccattaccgaactgctcagctacagaatccaagtgtacaccaatgaataaatatagattattgtaatatgtctgaattatgtaaagtggtgctaatataaatatat

SEQ ID NO: 7798 - DNA, 404 bp, Diabrotica virgifera
  Clone ID: LIB3026-019-Q1-E1-G1
agcaaataatcataatagaaaatcattaaatggcagtgtttatagatcaagagttacttacaacagccaattacttcacctggtactcaattttttatagaacatcagactttttatttatacatcctgtagatttgtttactttatacagatgaatactgagtggcagtattatacatagagcgggtggtgattttttttaaaagtcgccatcttaagtggttgagaaacgtttaatagccatataattctttatttattatcggatatagtagtcaatgtgcaaactaagtgtcagtataactataattatgttctctttgtatattagatgttaaccagagatctgttactaaatatatttttaagtagtagaatcagttttactgttgacggtttgtcac

SEQ ID NO: 7799 - DNA, 392 bp, Diabrotica virgifera
  Clone ID: LIB3026-019-Q1-E1-G3
agcgcccccgctccagtcgttgccgctcctgcgagagttgcagctcctcttgtagctcctgcagctcttccatacgccgcccttccagctgcttacagcgctcttcctgctgcttacagcgcatatcctgctgcttacagcgctctcccagctgcatacagcgctcttccagctgcatacagcgctcttccagctgcatacagcgctttgcccgcagctgctcctttagtagtcaggaagtaagcggattgaaggaaatgtgaccaaatacaacaaaccaactattacaaaaatatccttgctacggtggcatatagttaatgtattaagaagaaacgttgctgccttatcaggggtgaatgacctgtcgtgtatatagtgtatatttgtga

SEQ ID NO: 7800 - DNA, 396 bp, Diabrotica virgifera
  Clone ID: LIB3026-019-Q1-E1-G5
atttattttaaaataaaaataaattttttagtatatgttaagagtaattttatttattgattgatgattagtaatgtgagaggtgatattatatttaaatttgataaatttattttttgtaccttgtgtctcatggatcatggattagtaattacatatttaatatttacgaatttcgaatagctaagagcttaacatttatattgtaaaatgtatagtttaaataatatttaagttatgagttgtgaaacgttattcgatatatctaatatcttatgaattaagttatatttaattattaactatatacttataattaaatatttaaatattataaataataaatattattagggatgagcgtagagcttaacttttatttttaattaaatttta

SEQ ID NO: 7801 - DNA, 365 bp, Diabrotica virgifera
  Clone ID: LIB3026-019-Q1-E1-G8
ttcatctccgctgtttcgagcaatctttttgatctgtctgtgtcaggtcgtatttctgccgcatatgtcattattggtctgatgactgttttgtaaattctgcctttcatttctttttcgatatttctatttctctatatccaggccatctgcggctctatttggtctattcacttgatcttccacttctgtttcgagctttccgtagctagatagtgtgatgcctagatatataaattccatcacttgttttattatctgtccctccaggtctaatttatatctattggatttgctgttggaaccatgcattttggcatttttgggaaaattaacatgttaaattttttggcggttatattaaa

SEQ ID NO: 7802 - DNA, 413 bp, Diabrotica virgifera
  unsure (1)..(413): unsure at all n locations
  Clone ID: LIB3026-019-Q1-E1-H12
aggagaaatactcaacactacgaaggaaataaaaatgagctactttggtcacatactaagaaatgaaaaatatgagttgatgcgattagttatacaagagaaagtagaaggaaaaagaggaccggggagacgatcacgtcctggttgaaaagtttaaagcagtagagtggaaaaacaacaatagaaccagggagcccaataataaagatgaaaaatttaatttgtcataaacagtacatgaatagcccagtaaatagtccattttttcacggtttttgctctaaattttaaagaaccgcttggattgacatgaaatttggcatgcgtatagcttacatgtcaaagaagaaaagtgatattgtgccgatgtgtgcttttgccctggggggtgacttcacccctgnttgggggtg

SEQ ID NO: 7803 - DNA, 401 bp, Diabrotica virgifera
  Clone ID: LIB3026-019-Q1-E1-H3
aggcacgggtacatcctacttgacaaacataatataatgttgctgttttaaacgcctatagtgctacaatctatctaaggaactcgttaatattcagctcagcggggtactattgttcgaggtgttaaatttcataaacaagggatctacctgttttaagctgggatctcacggaacgtggcgcggcactttttaccagtttacagttgacgaagagaaatagataaagataaaactaaagacggtaatcaacgcaacgtgaaataacattctttcactcaaaatttgtggttgcgatccgtaggctaggacagatccctcaatttatggtcagcgcgtgttcttttatcatttgtcggtaaatgaacacggttcaaactaagtcagaagcttatacacag

SEQ ID NO: 7804 - DNA, 353 bp, Diabrotica virgifera
  Clone ID: LIB3026-019-Q1-E1-H4
agcacgcgtcagcccacgcgtccgagaaacatgaagactacctttgttttggccattttagtttgcgtcggtcttaccgtcagcgcccagaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtatagttggaattctgtaattaatttgtttgttagaatattataat

SEQ ID NO: 7805 - DNA, 409 bp, Diabrotica virgifera
  Clone ID: LIB3026-019-Q1-E1-H5
aattttgacaccttacataatttcgaaaatgtcgcaaactaaggaaataaagtcttatagttatttcgatagcccagacggccacgatgttttagataaattcttgtgcgttatgaaaccagcttcattaactgcatttggtattggaacaattgatgtagttgcctggtcacatcccaaggggtacctaccaactctgggacgatatgcatatatgggattccctattgtaggagcaagtgcagcttttgtgctcgttacaaatgcttctgcaagtttccgcaaaaaggacgatgtttggaattggttcattggtggtttttcagcaggatctgttgtgggagcctggaagagacatgccatgattggatttaattgtggaatgtttttcggcatacttgctgtatgc

SEQ ID NO: 7806 - DNA, 220 bp, Diabrotica virgifera
  unsure (1)..(220): unsure at all n locations
  Clone ID: LIB3026-020-Q1-E1-A1
ataatanaatattatttagtaaaagtaaagaaaaatttatttaatgatagttaattagtattgtgagagaaatatttatttttataaaagaaaaaattattttttgtaccttgtgtatcagggaatattaattaataattatatatttattattttcgaatttaaaagagctaaaaaattaaaatttttattgtaaaataaatattttaaataatttttt

SEQ ID NO: 7807 - DNA, 363 bp, Diabrotica virgifera
  unsure (1)..(363): unsure at all n locations
  Clone ID: LIB3026-020-Q1-E1-A2
cacgcatccgcgacctcaagaacttgattgtataatttgtatttcattgctacaagaatcgcgcatcattatcaacactccaatcgatttttcctaagaaatatttagccaaattcgatgatatattcttctagccgtgcttgtttcaaaccattccgggtggaggcggaccattttatagacctttagagctcactgagatggttttgctgtcaccccaccccttgctgagcacgacttggaggagaatgtatatagttgtacatttatttatttttttgattgccgtanataagttcaacatcctcgcccgggcgaagtatagactatatttttgtcattcggagactgcgaatattgctg

SEQ ID NO: 7808 - DNA, 430 bp, Diabrotica virgifera
  unsure (1)..(430): unsure at all n locations
  Clone ID: LIB3026-020-Q1-E1-A4
tgatagataattaatattgtgagagaatatttaattttaataaagaaaaattaatttttggaacctggggaacaaggaataataaataataaataaaaaattaataatttccaaattaaaagaaccaaaaaaataaaaattttaatggtaaaataaaaatttaaaaaaattttttggtaagaaaaggtaatccgttttaaaaaaaaccaaatttttaaggaattaaattaaattaattaataancataatattaataattaaaaattttaatataataataataaataattttaaggatgagctaaaaataaaaatttaataaaaattaaatttttaataaaaattaagaataaaaaatttcaaaatttaaaataaggtaataattaatttacacaataataattttaatttttataaatttttaataaa

SEQ ID NO: 7809 - DNA, 217 bp, Diabrotica virgifera
  unsure (1)..(217): unsure at all n locations
  Clone ID: LIB3026-020-Q1-E1-A6
tatcacaacttagtanacaatanatataatagaataaagaatcttgccgaattaagtgacgaaaatggatcacanatgttacagtanaagaattatacatacataatatagctttatttatttctatataatataatttgtacatacattcagaatttatatcactatgannacgtatgtgatatattacaattacnnatatatannaaaatatatt

SEQ ID NO: 7810 - DNA, 369 bp, Diabrotica virgifera
  Clone ID: LIB3026-020-Q1-E1-B12
cggacacgtgggttttgcagcaaacagttttaagttatttaaaccaactttagtaacaaaaaaatgtcacatcacggaccccctcaccgtaggagcccatccccacctccacctcaccaccatgggcctggacatgaccatcatgatcatggaccaccacaccatcatgatcaaggacctcatcaccatgaccatggacaccacggtagaccaccgccaccgggaccacctgctcgagaatatcctcctggacaatatcctcctggacatcaccatcctcccagataatagtttattcaggtaaaaggaggctaatcattattacattgtaaatcgcttattttattgcaataaaaacttttacataag

SEQ ID NO: 7811 - DNA, 361 bp, Diabrotica virgifera
  Clone ID: LIB3026-020-Q1-E1-B7
gcgtccgcaaactggcactctgatagatcatcgtctttcacacttgacctattcttcttccacccatatatcagttcaattcttcacatttctctttcatatttgattttccgtgtttcgattacccttttgacctccgtatttcagtttgcatattttttctatccttaagcccacttgactgtagatatctgttgtatatgcatatttttatagataatcgaaccttagtccgacgcctaaaaggtccttacgaacaaaaggaataatatatgattgtattaatgttgatatattttgtaatctaataaaagttgtttagttccatctagtcggtgtttatctgaaatcaaagtgtatg

SEQ ID NO: 7812 - DNA, 252 bp, Diabrotica virgifera
  Clone ID: LIB3026-020-Q1-E1-B8
cacgcctccgcgcacgcgtccgcacacgcgtacgatttttaattattttaaaataataaaatattttttagtaaaagtaaagaaaaattttacttaatgatagttaactagtaatgtgagagaaatatttacttttattaaacgaaaaattaatttttggtacctgtggaacaggaataatcaattaccaattaaaaattaataatttccaaatttaaacgaactaaaaaattaaaattttaatgggaaaaa

SEQ ID NO: 7813 - DNA, 494 bp, Diabrotica virgifera
  unsure (1)..(494): unsure at all n locations
  Clone ID: LIB3026-020-Q1-E1-C1
tacttaatggacaaacatgtattcatatggaataagttgtaatcattggttagttttatgtattagaaacaatgggttcctttttatttggtgcataaatattaagaaaactgatgaaactcatttgatcataataaacgatatttattaggattttcactttctaacaaaaattgtttgtggaagtttgacaaacaggaaaagaaacctaaacataagtgactcaaaaatgatttttcgtgcgataatagacaaaatctacctaatacccattcttcttaaagtcggtaatataatttattttatttatgatcttgtaaatgttattctgttgtgtttggcgattgtcctgcaagcagttaaataaaacttgcccaaaacggtttccaagtttcagtcaacacttactgtaatttaatccgttatgtaattttattgtatattatcaaatacaatttgatttggataaaaagatacacttganaacacaacac

SEQ ID NO: 7814 - DNA, 119 bp, Diabrotica virgifera
  Clone ID: LIB3026-020-Q1-E1-C10
ttaaaataataaaataatttttaagaaaagttaagaaaaattttaattaatgatagttaattagtattgtgagagaataatttaattttataaaagaaaaatttaatttttggaccctg

SEQ ID NO: 7815 - DNA, 216 bp, Diabrotica virgifera
  Clone ID: LIB3026-020-Q1-E1-C12
atttttatttattttaaaataataaaatattttttagtaaaagttaagaaaaattttaattaaatgaaagttaattaataatggtagagaaaaatttaattttaaaaaaggaaaaattaaattttggcacctggtttccacgggagttttaatttaaaattaaagatttaaaaattcccaatttaaaagagcccaaagattaaaattttaatgggg

SEQ ID NO: 7816 - DNA, 341 bp, Diabrotica virgifera
  Clone ID: LIB3026-020-Q1-E1-C3
tggccttatatccatacacagatacttgtactacaagtatactttgccttccgatagatattaccatttaaaaggaatattccatgacgagacgagacttaatcgcgctcaaacggggtccctgttgaaacggattcatgaaccggttcctcctgtccaacgatacagctggcccgcggtcgctgcaaaatacgaaaatggtcttccgggcagactacattacgacaactacatccaccggttgttaatgacctcgcctaactctaaaaccgaatacaccacctattacacggaacccgttaaaaaatatatcggcgacagagtatacagccgcaaggccc

SEQ ID NO: 7817 - DNA, 342 bp, Diabrotica virgifera
  Clone ID: LIB3026-020-Q1-E1-C6
gacccatgaagtcttgctttgaattggccattttagtttgcgtcggtcttaccgtcagcgcccaaaagaatgatgacataagtgacgaattgtgctatgcctgcgaagaattggcaaaattaatccaagaaagcaaacaaaggggaattccattggaagaagttgacgaaaaagtgagaaaattgtgccatcttttaccaggatttttggaagtattgtgcgattatcagttgattccagacatcgaccaaatgtacaaccagacggaagacatatctcctagagatcaatgcgtaaagttggaattgtgtaataattaaatttttgttagaatattataat

SEQ ID NO: 7818 - DNA, 79 bp, Diabrotica virgifera
  Clone ID: LIB3026-020-Q1-E1-D1
gaattaatgctccatcgaatgactttataggacgactacaaacgtgtagaggaacctctacaagacatggaatttgata

SEQ ID NO: 7819 - DNA, 257 bp, Diabrotica virgifera
  Clone ID: LIB3026-020-Q1-E1-D4
atcatggattttaaactccgaagaaggaaccaaaagttccttaattgccgcgttaaacaccgatctttaaggaaaatatatctggaaagaatgcactttaattgaatgggacagttacccaatgccgaatccaccctactaacgccattgttaccaaaatgcctaccgatggttccaaaatgaagtttaaccataaatttataataaaagccaatttgattaccaaaaaaaaaaaaaaaaggggcggcgccccaaaa

SEQ ID NO: 7820 - DNA, 423 bp, Diabrotica virgifera
  unsure (1)..(423): unsure at all n locations
  Clone ID: LIB3026-020-Q1-E1-D6
cacgcgtccggngccgcgtggggtacctataatatttgacagacaatatttgtatcatactatttctgcattgtatcatttagattcagaatttacacagaattgccaaaaatgtggcagccctgtactactcagactgaaagtaaaccccctcttaatattttatctactacagttgagatgtatttttctattggcttttaagtgcacatagagctatattggtgtatctatataatatatctataaatataaatgttatagatctatacatattgatgttatagaagttgtattcatatatttggtggtaaatgcgaaatgtcncaatttgaatatgttctccactattttgttaagtaaattataaatttttagaatgtgaagttagttttgtaagaattaataaatataataagtaac

SEQ ID NO: 7821 - DNA, 102 bp, Diabrotica virgifera
  Clone ID: LIB3026-020-Q1-E1-E10
acaattaacatgtaaatatatgtatattagatttgttttaaatgagtatatgaatcatttatatttaaatacaaacgaaaatatgatttaatatatttcaat

SEQ ID NO: 7822 - DNA, 266 bp, Diabrotica virgifera
  Clone ID: LIB3026-020-Q1-E1-E12
acccacgagtccggctgtttgaaccaacacacttcagatctttccgtgcgggctggatctgccaatcttacaagtgggggttacataatagacgtggacgattttgtaattcatccgaaatacaacaagaaaacctataactctgacatagctctactcaaattcgcaaaagaagtggagggaagcaatgtttcaattgctcttgtacctttccacgatacaagcgatgtgtccgatcataaaaggggttcaatgaacggttgggg

SEQ ID NO: 7823 - DNA, 101 bp, Diabrotica virgifera
  unsure (1)..(101): unsure at all n locations
  Clone ID: LIB3026-020-Q1-E1-E4
cacagtaagtctgaacatggtacangatcccaccaatatgatgtattggtaatgcctaatctgtatggtgatatcctgtctgaaatgtgcgcaagtcctgt

SEQ ID NO: 7824 - DNA, 390 bp, Diabrotica virgifera
  Clone ID: LIB3026-020-Q1-E1-E5
gaatacgtccgcacattcgaatgatagttagtgaacattataattggtgtgaataaattaacaatggaagagaatagtttattttaatacaggaaagctttactgttaggaatgtgtagtaacttcgatggctatatcatacatcattttatacttcatacgtgatttgtgcaacatcaccccttagaattttgagtgtgaaccaaatagtttcgtaaagtcatctgtagtgggacgtcctccatttttaactccagtattatttttcccagttagattaattgttaattttgcatttgtgtttatactgaactaatttttatattatgtacatgatagtatttttacgcgcagtgcttaaagagtatttattattaaaaattaaatttt

SEQ ID NO: 7825 - DNA, 358 bp, Diabrotica virgifera
  Clone ID: LIB3026-020-Q1-E1-E8
cgccctaccaataaatggtatagtcttgcggattgggatatctcagctaagcaaatcaatgacgacgaagatttcgaggctgtctttgactataccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccaccgtcttaacacctaagcccattgtagacagttttaccgtcgactggcaagttgcagatgtaaaatgcaaaatcactggtatgggaataattggagacacttatgctctcgctattc

SEQ ID NO: 7826 - DNA, 112 bp, Diabrotica virgifera
  Clone ID: LIB3026-020-Q1-E1-F2
aataatatttaataatttttgtatgaaagtatccgtttaatatactaattttaagaataataaattattataacatatattataataaatattttatatattaatataaata

SEQ ID NO: 7827 - DNA, 109 bp, Diabrotica virgifera
  Clone ID: LIB3026-020-Q1-E1-F3
ttctaatttctattatcttattatttaattatttaaaaattttttatataaaacaattattaataaattaaaatttaatgatttaataagaatttaaattaataaataa

SEQ ID NO: 7828 - DNA, 340 bp, Diabrotica virgifera
  Clone ID: LIB3026-020-Q1-E1-F4
ttgtgagagaatatttaatttttataaagaaaaatttaatttttggaacttgtgtaacaaggaataataattaatattatatattaataatttcgaaatttaaaagaactaaaaaattaaaattttaattgtaaaataaatattttaaataattttttggtaatgaaatgtaatccgtttttaaataaacctaattttttaagaaataaattaaatttatttattaccaatatatttataattaaatatttttatataattaatattaaatatttttagggatgagcttaaaaataaaattttattaacatttaatttttaattaaaaattacgattaaa

SEQ ID NO: 7829 - DNA, 474 bp, Diabrotica virgifera
  Clone ID: LIB3026-020-Q1-E1-F6
cttttcaatcagggaatctcgggcccgggatttgtttcgggcttctctaatatgtcgtataatccgtgtaatgccctattgtaatatgcccgtgtaatgcgtaatataagcgttgtaatgccctattgatcgtaattagcgtttgtcgtatttcatttgagagtaacgtacatttctgtaataaagaaaatcatattttattatttctgtttttttatcaatcaagttctgttgaccacttgtttgatgaaaaaaaaaacagttttgttagactaaaatacagagaatacaaggaaccgccaacttgcacaataattaaaacgtatttagaaagttttatactaatttttttaataattgctcataagaatttacaaaaattcccatgtgatgttttttaattagtaactttttttctagccgtaagtttttgtagcattaacgttaacatggttgtttactaaaattaatttt

SEQ ID NO: 7830 - DNA, 88 bp, Diabrotica virgifera
  Clone ID: LIB3026-020-Q1-E1-F8
aatttatttattaccactatatttataattaaatatttttatattattaatattaactatttttagggatgaccttaaaaataaaatt

SEQ ID NO: 7831 - DNA, 221 bp, Diabrotica virgifera
  unsure (1)..(221): unsure at all n locations
  Clone ID: LIB3026-020-Q1-E1-G1
ccgctaagtctactcttatgtcaaaatataaacacggaatggttgtatcacactctgataaataaagaacttacagtatgtccanatgagggggatattgataatacctacaactttgtcaaaattctttgttcaagtaaattgccgtntggtatcacagatgtcaacaagcaaaagaaatcttttacaactgatgaaattgttgagtattacaaaaatgc

SEQ ID NO: 7832 - DNA, 230 bp, Diabrotica virgifera
  Clone ID: LIB3026-020-Q1-E1-G9
gttgggcttggtactccccgtggtgccgtccacgtctgctcttggagtccagggacctggcacttgacggtccggacttggcttcgggtgggaaccctcttgtggcggttgaggcagcggagcacctcccaatccttggtagccctgcttttgcatcggatgcatgctgcactgctggagcacggtgggcgtattccacatgtcctgaccgctgcggtgccttcatgctg

SEQ ID NO: 7833 - DNA, 447 bp, Diabrotica virgifera
  unsure (1)..(447): unsure at all n locations
  Clone ID: LIB3026-021-Q1-E1-A2
aattccggagcngacccaggcgtcagcggacgcgtgggcggacgcgtgggatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgatanatatagtattaaaaaaatgtatatttaagtaaaaatat

SEQ ID NO: 7834 - DNA, 205 bp, Diabrotica virgifera
  Clone ID: LIB3026-021-Q1-E1-A4
aattccaagccgacccaggcgtcagatgatgatgcagaagaacatgtgccacaagtagaagaaggcgatcacgatgagttataaaaatattgtaaagtgaacaaaagagactttttttaaaaataacaggtgtgaagtgttttgttcgatagtgtgtactgtcccttgactgatttttgttatttttgatcgtattacttctaat

SEQ ID NO: 7835 - DNA, 346 bp, Diabrotica virgifera
  Clone ID: LIB3026-021-Q1-E1-A7
cacgcgtacgattaaactagttttaaataagtaagttaattttaatataatttttaattcatgtcaactgaagttacaatagttctgtaagaattcgactatttgtgtttttggactcttattttgtaattaaaacacttagaatacaaacatttttcttataaaaaaaaatcaaatttttaaaaaaataaaaaaaaataaaataaaaaaaaaaaaaaaaaaaaaataaaaaatttatataaaaaaaaaaattaaataatttttaagaaaaaagggggggccccccaaagggttcaaactttacttacccgtgaaggcaaattaaaaccccttcaaaagggtcccc

SEQ ID NO: 7836 - DNA, 413 bp, Diabrotica virgifera
  Clone ID: LIB3026-021-Q1-E1-B11
gccaaaaaatgaatactattattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtgggtttccatttgttaccaaacaggctgatgttgaatacttaggagatccttcaaaagttatttactgcgttcaagctctcagctctgatgacccaagcgttggttctattgctgaaattacaattggtggagttggtcacgatttcgtaaatgtacatttgacatctaagaaaggaggacccctacattacgatgttgaaatttacgccagggcaccaaataataataataaataataaat

SEQ ID NO: 7837 - DNA, 363 bp, Diabrotica virgifera
  Clone ID: LIB3026-021-Q1-E1-B12
acgaagacggtgaacctctctacgtaggacgtgtcgtacatgacggagcattgaccgttggaaaggtacaacaaagccatggagtctgttacatcccatacggtggtcaagagatgtctttcccagactacgaaattttggtacaataaacagaactaaattgtttaagctttggatgtgctgcctaggatattaatccacaaaatatatttacatatatataaaaaaaataatagcaagtaaaagctacatgaagatttatatggcttctaggtgcctttattacccttagggatatgtatttttagaaggagataattcacttaatatttgtgataaggagtttttacataattacatgtg

SEQ ID NO: 7838 - DNA, 394 bp, Diabrotica virgifera
  Clone ID: LIB3026-021-Q1-E1-B5
cccacgcgtacgcgaaaatgattgcttttgcagtaactttttgtttgctggtaatatctgcacagggacaaattcctgttgaaagatgtccagatgtaaaaggagtggcaaatttcgacggatatgcatatttgggtaactggtacgaacaaggtagatatccaactttactggaagattacggaaaaagtgttggtaacaataatgcaatagggccctataagtagaactataaggagtcgtacgcaatatatcaattcagaaacaaatgagacacacgttctagaaggagaagtacaacaaggttcaacaactggggaaggtcgatttctagtacatttcttaaatccagacgtaactgtacctttctatgttcttggtacagactatgaaa

SEQ ID NO: 7839 - DNA, 412 bp, Diabrotica virgifera
  Clone ID: LIB3026-021-Q1-E1-B9
agctggtccaaacaaacgcgtgctagatgaactcctgaagggtatagagagagttaacaagcaagccacatccaatgctcaaactataaagaagatatcagtgcttcctgctgatttctccatacctacaggagaattaggtcctacaatgaaaagtaagcggagaattgttgaacaaaaatataaggatatcatcgaaagaatgtactcttaagaaacaattattgttgctgttgttattttgttattgttgttaaatatacttatatatttatattttaatataaaaggtgtacaaaaaactccatttttgaaattattatacttaactaatgaatagtaattgttaaaatctcagatgcaccaattaaaatcctatttatcacaaacaaaaaaaaaaaaagggcggccg

SEQ ID NO: 7840 - DNA, 368 bp, Diabrotica virgifera
  Clone ID: LIB3026-021-Q1-E1-C5
acgacaaaatccactaaacatgttgcggctttctttcttgtttgtagctctcttgatcctttcagctgagcttgattcagctgttctgaaagatgattttgactacatcccagataggccgcaagatcccaaagaggtcacatctagctcttcggtggatccccttagtcctgaaaatggtgaaattgacattcccgaaggaaatttgacgggttttaacggcactggaaaggatttgtttgtgataaaaacgggtggttaagaaattggaattttgacggatgttggaaatgatactaacttcgacaatgaaacccatgaacaaatcgacgtgtcatttttcgaccaacccacaacggctccatcat

SEQ ID NO: 7841 - DNA, 334 bp, Diabrotica virgifera
  Clone ID: LIB3026-021-Q1-E1-C6
acgtaaatttttgtttgcaaaatcagctgttactcatttctacggtgtagcttttgtacgtgccttgtttttctatattattttttgtactgaaattgtgatatgagcattggagccaaataaataaatattaatcaaaaaaaaaaaaaaaaaaaaaaaaaaaaaaaaaaaaaaaaaaaaaaaaaaccaaaaaaaaaaaaagaaaaaaaaaaaaaataaaaaaaaaaaaaaaaaagaaaaaaaataaaaaaaaaaaaggaaaaaaaaaaaaaaagaaaaaataaatgacaaaaaaaaaaaaaaaaaggggcgacccctcaaaggtttcaaattt

SEQ ID NO: 7842 - DNA, 451 bp, Diabrotica virgifera
  unsure (1)..(451): unsure at all n locations
  Clone ID: LIB3026-021-Q1-E1-E1
aattccgtagccaccagnctcagattttcaaattcgttgcaaaacgaaaacacagccaaaccatattctagtccaatcagagagtgctgcaagcacgcctaccggtttcgaaacttattagtctctcatcgggaggcacatatgctgctctccctgatccaaccaaaacaaaccccagcgtgcagtcccggattgcaacgaacgaaatggcatagatgccctagcggcaactgctagcaaaaatactaagttttcactctaatggcatataaaacaacataatgctattctacatcccaccagaatgaaaacaatgggaaccttttctggttacacctccgaggcttctacaatttgcaatccatacggatgctgagactaggaagatgatttttttcattttatccttgcccatacgtcatgattcattttttaaacaagttaaatcaaa

SEQ ID NO: 7843 - DNA, 71 bp, Diabrotica virgifera
  Clone ID: LIB3026-021-Q1-E1-E4
aattataacttaatataatatttttttgttccattttttttgattataagattaatttaccttagggataa

SEQ ID NO: 7844 - DNA, 370 bp, Diabrotica virgifera
  Clone ID: LIB3026-021-Q1-E1-E5
acgcagaaactttcagagctcgatagtcgagctgatgcccttcaagaaggcggcaaaaggttcgagcagcaagcacaaaagttgaaacgaaagtattggtggaaaaatataaagatgatgattattatgggggttataggcctcattattttaattatcattataatttccattgctaatgcagttaagggcgacgacaccacatcctcaagcgtaacgtcggctcctccaaaatgaaattaaatgtttacggatctttctgtatttgattatatattccgtatttgattatatatatttattgttgcattatacttaaaaataagaacaaaatattttacaattctatgtttgctttatgtcattattt

SEQ ID NO: 7845 - DNA, 376 bp, Diabrotica virgifera
  Clone ID: LIB3026-021-Q1-E1-E7
aattcccggcggaaaatttgtattatagcaatctgtagctattacctccaaaaagtgaatggtgatgctggtatgtctgctgtttgatacaaaaaccaaactcgtatcacgagttgcctttttgtaccatccggtaacgctataatatcgatttggcttttggtcaaatcgaatcttaaggtgctgtttttggtccagctgcgaaattcttgtgttaagactctaaattgttcgccgtattaatgaggattttctagttttatcaaaaacggttccatgttgtaaatatcgtgcaatataagtgtatgttatatattttatatatttttgtatatttttttatgaatacggtgacaaataaatgtatttttagtat

SEQ ID NO: 7846 - DNA, 461 bp, Diabrotica virgifera
  Clone ID: LIB3026-021-Q1-E1-G1
taccgggccacgaattcccgaaccgacccaggcgtcagcccacgcgaccgcccacgcgtccggggattattaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaaataattaaaatttagtaatgatgataa

SEQ ID NO: 7847 - DNA, 316 bp, Diabrotica virgifera
  unsure (1)..(316): unsure at all n locations
  Clone ID: LIB3026-021-Q1-E1-G4
gatccaggcgtcagcccacgcgaccgaggagttaaagtcgtgccaaanacggaagacaanactaagaaaaaggataatttgggggcggaggtttgataaagacctangggatattttaagcagaaggctcaaggaaacaagagtgagagtgaagatgaagattctcgtattaacggtgagagatatgataggtttaaactaagcgagaaaggggatgaagatggagtagagaataagttgattatcaatgacgtagaaactaaataaatattaattatatttgggtccaatggtgtttcagtagatttagtgtact

SEQ ID NO: 7848 - DNA, 378 bp, Diabrotica virgifera
  unsure (1)..(378): unsure at all n locations
  Clone ID: LIB3026-021-Q1-E1-G5
acggtaaaaataacaactggcgaattaggtataatagagaaatatacgagcaatatagcgaaccaactctagcacaacacactaaactgcagagattacggtgggcagggcaagtggtccgcatgcatgagaatagaatccccagaaaattgctgaatgcaagaatgcagggaagaagacctgttggaagacctaaaaagagatgggaagacgaagtcgatgaggatgccaggaacttcctgggaacgcgttcatggaaaagaacagcggtaaatcgaaaagattggagaagcttattgaaggaggccaaggctcgatttgggctgtantgccattggatggatggatattttaaattaggttgttccattanttttt

SEQ ID NO: 7849 - DNA, 378 bp, Diabrotica virgifera
  Clone ID: LIB3026-021-Q1-E1-G6
acgcttgattatggcatggaagttttgagatgcgccaacaaagcaatgagaccaggagtacctgaattgggagttccacaacatgatcccttcgtcgcctttagtaagaacatatcatggcatggagacatcggtgttgctagcacctcaatcgacatcgacacattgagatggtatggtcttgccgactggaacgttactgctaagcaaatcaatgatgacgctgataatgtagcggtctttgactgggtcaatagatggcccgttttcacaatctccggcaactaccgagcaaccgttaaagaactgttccttacacagcattacaaaggaagcttcaaaatggtcatggagaaaccagtatggactggaaaaata

SEQ ID NO: 7850 - DNA, 260 bp, Diabrotica virgifera
  Clone ID: LIB3026-021-Q1-E1-G7
aagcggacgcgtgggaataaattatatttgtaaaaaaaaaaaaaaaaaaaaaaaaaaaaaaaaaaaaatagaaaatccacaacaaaactaccttcaacgccggccgcccgggcagttcctggcctggctagcccgctgtcgccatcatctctctccacttcggccccctgagttcggttcaccgtgcgtccttttacaattgtcgtcacgcggaacactctggagtcacccaacgtacccgccttgtactgggccccctt

SEQ ID NO: 7851 - DNA, 171 bp, Diabrotica virgifera
  Clone ID: LIB3026-021-Q1-E1-H2
atccataacatatgttattgtatcatgacagatgaagtactgtgtacaaaataggcaatttttaaattagtttaatcatatttaaattatttcataccattggactaagtataccaaacactgtccagtacgactgaaacattcagtatcttgttatttttttgtccttgt

SEQ ID NO: 7852 - DNA, 359 bp, Diabrotica virgifera
  Clone ID: LIB3026-021-Q1-E1-H4
ttccaggctctagcgacgcgttattcataccattattaaacaaaagtaaaattttctgaggtggctctaataatatgatcacccactgcatacctgtaaatttattataacggaatcaattttgcttaaaatttggaattagacttattttacccccctcttcataagttatatatatgtgcagctgagatttttatttgtaaggaatgaaaacaacctcatattgaaaaaataaatattaaagcgttttatagatttaaatcaaattagattatgttattgaaatattttcaattgtagtaatgattgttttatacattgtcgaaccttgaacaatctaaaaaacttccccctttaat

SEQ ID NO: 7853 - DNA, 370 bp, Diabrotica virgifera
  Clone ID: LIB3026-021-Q1-E1-H7
gtgtttataaaaccacgaaaatgattggttttgcagtaactatttctttgcttgtaatatctgtacagggacaaattcctgttgaaagatgcccagatgtaaaaggagttgcaaatttcgatggaaaagcatatttgggtgactggttcgaacaagcaagatacccaactttactggaagatcacggaagatgtgttgttaccaatattgcagtaaactcaaatggatctgtaaagagtcgtacgcaatacatcaattccgaaacaaatgagacacatgttctcgaaggggaaggaatatcaaattcaaccacaggagaagccaaatttttagtacattttcttaatccagacgtaactgtacctttttg

SEQ ID NO: 7854 - DNA, 318 bp, Diabrotica virgifera
  Clone ID: LIB3026-022-Q1-E1-A1
gcgtccggaagttaacgcaaccagctacaaacacattcaacagacgttcgtaattttttttataatgtaattgacatttaaaataaatacaaagtatttgtacaaaaaaaaaaaaaaaaaaagaaaaaaaaaaaaggaaaaagaaaaaaaaaaagaaaaaaggaaaaaaaggagaaaaaacaagaggggaaaagaaaaaagagcggaagcagagaacaacgagacgaaggggaaaaaaaacacgaaaaaaaagggggggggcccaaaagggtaaaaagcccggcgggggaggaaggggggggaaaccccccacaaagg

SEQ ID NO: 7855 - DNA, 352 bp, Diabrotica virgifera
  unsure (1)..(352): unsure at all n locations
  Clone ID: LIB3026-022-Q1-E1-A10
gtccggcacctacagattccaccaaacctgctattgccacattaacacatcgatttctgactaccacgcaggaaacacctacctcagtaaatacctcattttcaacgctagatgtgtagatagcggcacctatctttgtttagcactcacgcagttcggtaaagacgaccaaaaagtgactatcaatgtgccgtgtaaaaaatcggatagtgaattatattccttgttgtttttaataccgtttggactgttgttgatacctttagttgtatggctatgttattataggacgaaaaagcatctactatcataatcgtcgaacancagaaaaagcttctcaggactataactc

SEQ ID NO: 7856 - DNA, 193 bp, Diabrotica virgifera
  unsure (1)..(193): unsure at all n locations
  Clone ID: LIB3026-022-Q1-E1-B7
cacgacgtccgaaagtttttntttattaatctttttaacttagctggtactttaacttacatgtttccgtcttatgtcctgtattacagaatgtgacatcggctttagagaattacattctattgacgatttatcgcgccctaggtgaaatcgtcataataatatcttttcccggctggagagccactcttaa

SEQ ID NO: 7857 - DNA, 254 bp, Diabrotica virgifera
  Clone ID: LIB3026-022-Q1-E1-B8
ccacgagtccgcactcaagtgctttggcgaaaagaccaggccagtaagggagtaaacatcaaggatctaatcaccaacattggatctggagtaggtggaggcgctccagcaggtggtgcctcagctgctgccccagccgctgcagctgcagcagctcctgccaaggaagacacgaaggagtctgaacctgaagagtctgatgatgatatgggtctcggactcttcgaccagaaaagtccaactgttttttcagg

SEQ ID NO: 7858 - DNA, 386 bp, Diabrotica virgifera
  Clone ID: LIB3026-022-Q1-E1-C11
gtccgcacagatgacacggaaatctccaaaattgcccaacaagatcacatgcagtatgggaaatggtacttaacgaactagatagaagagaagatcctgaaaatgatgagtatttaccaggttgtgccatggttgactcatgttccaacattcttactggagatcaattttataacttcttaaattataatttcgataggcattacaatgaaaacagagctcctttgggtctttacttccatgccgcttggctaaaaaatcatcccgaattcttggatgccttcctttactggatagatgaaattctctcagaccatactgatgtatattttgtaacagtgacacaggttatccactggatgccgaatcctagaagcgtcgccgac

SEQ ID NO: 7859 - DNA, 468 bp, Diabrotica virgifera
  unsure (1)..(468): unsure at all n locations
  Clone ID: LIB3026-022-Q1-E1-C2
ccaggcctccggaaataacaacaatgctagctgctaaagttgtcttgtttttgggccttgcccttttcgtctcagccggtgaagatcttgacaagggttatgaaattgtggaatgtgccaattatgtaatgagagcaggagtacccgaattgggagtaccacaacacgacccctacgtcaaactcagggacctacaatggagtggaaacctcggtgttgccaaagcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcanggaacatcaagataaccatgaaacaaccagtttggactggaagaatcagcgcac

SEQ ID NO: 7860 - DNA, 417 bp, Diabrotica virgifera
  Clone ID: LIB3026-022-Q1-E1-C8
acgagtccgtagaaaacgaattgtccaaaatgctgcttaaaattgtcgtcgtttgctgctgcatttcaattgcactcagtcaagctgttggaaaatgtcccagtgtagatggtacatagccagtagaccttcctgatgcaacatcctgctcaacattttatgaatgttctaatggaacaccataccaattcaaatgtgcgtatggaacatatttcgacagccagagcagaatatgcagacataaacgagacgtcaattgtggcagtagaaggagagattagtactctagttaaaaagatgtaaatttgttgtaattcgcgtagtacctgtgatacacatattttttacatcgtgtcaaaaattaaacacgtgagtgcgcagtgattacatctacctgacctcctaggaagggcggcc

SEQ ID NO: 7861 - DNA, 377 bp, Diabrotica virgifera
  Clone ID: LIB3026-022-Q1-E1-D10
ccgtccgaattattaattaacaatatatttataattaaatatttttatattattaatattaaatatttttagggatgagcttaaaaataaaattttattaaaatttaatttttaaataaaaattaggattaaaaattttcatattttaaaatatgttatgatttatttttatatattattatttttattttttataaacttttttattaaaatatacatttaaattatttaaatttagtaatgatgatactattagtagtaaaaaattgtatacttagtataaatatataggtttaatacacgaattcggcaacatttttttcacctgtttattacaaacatctctttttgtattaactatcattctcgcctgctca

SEQ ID NO: 7862 - DNA, 305 bp, Diabrotica virgifera
  unsure (1)..(305): unsure at all n locations
  Clone ID: LIB3026-022-Q1-E1-E10
gattatggcntggacgttttgagatgcgcctccntggcgctgagaccaggagtacctgacttgggagttccacgacctgatcccttcgtcgcctttagtaggaacatatcatggcggggagacatcggtgttgctagcacctcgctggacctcgacccattgagatggtatggtcctgccgactggaacgtctctgctgggcgggtcgctgatgacgctgatcctgtaccggtcttggactgggtcgcttgatggcccgttttcacagtcgcgggcctctcccgcggccccgttgctggcctgtt

SEQ ID NO: 7863 - DNA, 435 bp, Diabrotica virgifera
  Clone ID: LIB3026-022-Q1-E1-E2
ccggattgcttttgcagtaactttttgtttgctggtaatatctgcacagggacacattcctgttgaaagatgtccagatgtaaaaggagtggcaaatttctacggatatgcatatttgggtaactggtacgaacaaggtagatatccaactttaccggaagatcacggaacatgtgttgttaccagtattgcagtatgccctataagtagaactataaagagtcgtacgcaatatatcaattcacaaacacatgagacacaccttctagaatgagaagtacaaccaggttcaacaactggggaatgtcgatttctagtacatttcttaaatccagacgtaactgtacctttccatgttcttggtacagactatgaaaattactctgtacgtttcgtccgttttgaacctcatagtgtttttctaaagaatccttt

SEQ ID NO: 7864 - DNA, 75 bp, Diabrotica virgifera
  unsure (1)..(75): unsure at all n locations
  Clone ID: LIB3026-022-Q1-E1-E3
ccgaaaaaaanaaaaaaaaaaaaaaaaaaaaaaaaaaaaaaaaaaagaaaaaaaaaaaaagggaaaccaaacaaa

SEQ ID NO: 7865 - DNA, 265 bp, Diabrotica virgifera
  Clone ID: LIB3026-022-Q1-E1-E4
ccgaattttataaattttagactaatagaatattttttagtcaaagtatcgaaaaattttatttaatgatagtcaattagtattgtgagagacgattttatttttatacaacacaggttcatggtttgtcccttgtgtatcagggattaggaagggatcattatatacttattgctgtcgaatttgcgcgagctgcatctttcgcatttttattgtcgactccatctttcaactactttttttgtacgtcaactgttattcgtct

SEQ ID NO: 7866 - DNA, 119 bp, Diabrotica virgifera
  Clone ID: LIB3026-022-Q1-E1-E7
cacgagtccgcaaacgcgtccgcccacgcgtccgaaaatattaaaaaatgttgaatgaaataagtgtttcgtttaaatacatgttttcgtaatatgtatataaataaataatacttgtg

SEQ ID NO: 7867 - DNA, 365 bp, Diabrotica virgifera
  Clone ID: LIB3026-022-Q1-E1-F11
tccgcaaacgcgaccgcggacgcgtgggtggagctattttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacccattaatatgaaagtcagaataaagtcaaaagtttaacgagaatttttgaa

SEQ ID NO: 7868 - DNA, 411 bp, Diabrotica virgifera
  Clone ID: LIB3026-022-Q1-E1-F12
cgtccgcacacgcatccgcccacgcgtccgcccacgcgtccggaaacatgaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataataagcactcacaattaaatttgaaactccgcacgccgccccc

SEQ ID NO: 7869 - DNA, 224 bp, Diabrotica virgifera
  Clone ID: LIB3026-022-Q1-E1-F5
acgagtccgtaggaaaatacatacacaaattaattctttggcaaggttgtcaaaaccaaagtttcagcataattggttagcatgacgacaaacaattgaaaaaaaaattgaaaacaagggacagaagaatatgaaacaagattacaaaaaaaattgagtatacaaaagaatttagagaagaaaaatcactaagaggatttaaaccttcaaggggttgaaccggg

SEQ ID NO: 7870 - DNA, 133 bp, Diabrotica virgifera
  Clone ID: LIB3026-022-Q1-E1-F6
tccggagcgatagatgtggagtaaacagggttgatgctaatggagaattaggttgtgagggtggtggcagtggttatatgtggaagagttaatatttatgggcagtatatagggtttggggatattgttttgg

SEQ ID NO: 7871 - DNA, 395 bp, Diabrotica virgifera
  Clone ID: LIB3026-022-Q1-E1-G3
ccgattagctgaaacctatcaaatttttaaaatgtacactaagtttactgttgttgcccttttattgtgtgttgctttaaatgaagtacatagcggagttatactcggcaaaggattaggtagaagttttacagcatgtcctgatccccttaacccaggaatattggtatccgacaacgacatttcaggaggtctcttcgaatctatcaacttaagagttccagaaataggattgttagaaacgcctatttcatgcatattgatcgttgataaaaagaagagttcaactgacccaattattggtgcaggaggtgtaggttctccatatgttgaaataagtatcaaaccaggattcttcgaatctcttcattataggattgaagtgtacaggaaag

SEQ ID NO: 7872 - DNA, 328 bp, Diabrotica virgifera
  Clone ID: LIB3026-022-Q1-E1-G6
tccgtacagttcccatattctaatgtttgtaacttaaatatatgacttttattttgctgtttaatatactattgtcaagcataaaatgggatgtgtatgtaaactttattcgaaagctaaagtactgtgccaattatattttaagtcttgctatccacttaaatttttaaattataaggttaaaaatacctacctacaggcctcctgttaaagtctaaatgatcatttttagacaatatagaagtagagtagattgaaattagagtttttgagatatctcacgtgtgtcagatagatgttacattcgtgtatgcagctctggttttag

SEQ ID NO: 7873 - DNA, 94 bp, Diabrotica virgifera
  unsure (1)..(94): unsure at all n locations
  Clone ID: LIB3026-022-Q1-E1-G8
attttaaaatgaataaaatatntttttaaagtaaaagtaagagaaaagattttgatttaagtgagtagttgaattaggtatgtgtttgagagaa

SEQ ID NO: 7874 - DNA, 178 bp, Diabrotica virgifera
  Clone ID: LIB3026-022-Q1-E1-H1
gaagctgtggctgctgttgtcacacctgtagatatgccagctcctcttgaaggccaagacttggactggaatactactgatactactggttggagtgctgaagttgcaccagttgctcctgttgcgggacctgcatacagtgttagtgctagtcaagattgggcttctgaagttgctc

SEQ ID NO: 7875 - DNA, 428 bp, Diabrotica virgifera
  unsure (1)..(428): unsure at all n locations
  Clone ID: LIB3026-022-Q1-E1-H10
ataataaaatattttttagtaaaagtaaagaaaaattttatttaatgatagttaattagtattgtgagagaatattttatttttataaaagaatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcagatgtaaaatgcaaaatcactggtatgggattacttggagacacttatgctctcgctattcaagaaggtattgaaggtgccctcnaacatggtcttatcggaaataccgttggagacttccttaaaatgagattcaacactgtctggtatcccactggcaaa

SEQ ID NO: 7876 - DNA, 415 bp, Diabrotica virgifera
  Clone ID: LIB3026-022-Q1-E1-H2
ccgcagacgcgagggcttttattatcttctatttaatatatctctttcatttaaatcatcatactgaacatacctcgtatattcatactctccaaatatctgtattttcaatacggaacatgccgctacttcatagtacttggttgtcattttaaatgtcgttttcaatgacagtgtcacttcatcgacttgacatacactggaaggaaaaaattaatccttaaaagggcatgtttttcgaaaaaaaaatctttccattatctaaacacctcttggggggttgagaacattatattgtgatgatatttctccgtctaacaatttttatattgtgtttttttatctaacctaccttcctatgtcagaccatgtgttctgataatttagtttcaaatataattatcctttaatttac

SEQ ID NO: 7877 - DNA, 390 bp, Diabrotica virgifera
  Clone ID: LIB3026-022-Q1-E1-H8
tccgcaaatgcgtccgcaagtctttttgcgagttagaatatcatgttgatcgtcatgaagttcgtattggtcgctctagttttggccgtactgatgtgctaagtgatatgtgatggtgatgatactggttcctccagcaccaccatcgcggtcaccaccagcgaagctccaactaccacggccagttcgaatgcggaacaatcatcaacaaactcagcacctgagagcagcaccaagggtggtgcatctacggtcagacccgcaataggacttgtattgggaaccgctttactgtgtctccactaaaagcatagtggacgcttttgtcaagtcactgttcactttaacacactcacttacattattattctcgaacggcacatcaatttg

SEQ ID NO: 7878 - DNA, 419 bp, Diabrotica virgifera
  Clone ID: LIB3026-023-Q1-E1-A10
cacgcctccgcaaacgcgtcagaccagaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaatctgttgctgaaattacagttggtggagttggtcacgatttcgtacatgtacatttgacatctaagagaggaggacccctacattacgatgttgaaatttaccccagggccccacataatccta

SEQ ID NO: 7879 - DNA, 378 bp, Diabrotica virgifera
  Clone ID: LIB3026-023-Q1-E1-A9
cacgcgtccggtacagactaagcaaattccacaaatgtgtggtgggtttctaaaatggttgcctaaattatccttattgacgaaaattgtgaagcacatgcaggaatttttaaaaatggaaattcacctactatcagtccgtaaatatattaaaagtaatgggtaatgtacacgcctattcttctaaccctcatccaccaactccaccaagtacaaccttcccaaggaagaaggatactgatcctgcacctagtcctccggaggtgattgaaaatccaggaccattagaagagattcattcaaagtgcaaaaatgtcttccccaacatgttttgaacgcgctagagttatgcttacaagacgtcttagtaaccacttc

SEQ ID NO: 7880 - DNA, 352 bp, Diabrotica virgifera
  Clone ID: LIB3026-023-Q1-E1-B3
gtccggcaaactataggtcttagttactaataggttgttcaatgaaaatgtacgaaacgacactgtgggtataaatgaagtctttattcaaagtattcaccatttacctgagcacaacgatgccgttgattagccgaaggattcattgatcccagaactcctgtgaccatgaacagtcttccccgtatacatccggcgttgaatagcaactggtttaactaacaccttccgccgtcagaaacctgataacgcctcacgaattttgcaacgtgaacgccatgatgtgcccacacgaactgtcgcgtcaattgaacggctctcttataagagcctctattctctcctgcgcatg

SEQ ID NO: 7881 - DNA, 150 bp, Diabrotica virgifera
  Clone ID: LIB3026-023-Q1-E1-C5
acgcgtacgccagcgcgtccgccgtcagatggctaacaagcccaaacaatcctttattgcacaacacgtagccgatcccaatgtccaacctgtccaagacgttgattggcgagacagtgccgtgtggggagtcccccatccccgacagtc

SEQ ID NO: 7882 - DNA, 184 bp, Diabrotica virgifera
  Clone ID: LIB3026-023-Q1-E1-C7
cacgcgtaagcaaacgcgtgggcggacgcgtgggtttttttgatcgattcggttactgttatgcttttgactatgcactggcgtgctgtttgcgatcactgactccgaatatttgacattaggatgacgtgtagtatttgatatgttagattggcgagagaccgtcgatatcatttagcggcct

SEQ ID NO: 7883 - DNA, 341 bp, Diabrotica virgifera
  Clone ID: LIB3026-023-Q1-E1-D1
gcgtccgcgagaccgtgggcggacgcgtgggtttttaagctcatccctaaaaatatttaatattaataattaaatatttttatattattaatattaaatatttttaagctcatccctaaaaatattggatattaataatataaaatatttttagggatgagcttagaaataaaattttattaaaatttaatttttaaataaaaattaggattaaaaattttcatattttaaaatatgttattatttacttttatagattattatttttagtttttataaattttttattacaatataaatttaaattatttaaatttactaatgaggataatattagtatt

SEQ ID NO: 7884 - DNA, 401 bp, Diabrotica virgifera
  Clone ID: LIB3026-023-Q1-E1-D10
tccgcagacgcgtaggcggacgcgtgggtgttgtttgaactaagagctccgtttaagctagtatacaaaaagttctcccgcacttccatagatttcttatttttaatcataactcaagtgttcatcaacgttatatctacacaggctacaatgttatcgtgcaatcaggaattacaatcaccatagattttttaaccacgtctggtttgtgattgtgatggcaaatgttttatccttgaactaatgaaaaaaaatttaagtttatacatattggcgaacagtttgatagatatagtaagtgtttttctcctgactcagattttgtatttcttacaaagacgttccatacagaacaatacttttttgtggaaagttatcatggtagtatgttagaatggtgc

SEQ ID NO: 7885 - DNA, 249 bp, Diabrotica virgifera
  Clone ID: LIB3026-023-Q1-E1-D8
cacgcgtcagatatggcccgaaaattttttttatatctacatttattcagttttgccaaactactaacagatacgtattttcgaatatccttttgattttaacaaagagcattgattattttaagcttctagatgtgaaataaacggtcaaccacaaaaaaaaaaaaaaaaaaaaaaaaaaaaaaaaaaaaaaaaaaaaaaaaaaaaaaaaaaaaaaaaaaaaaaaagggcggcggcccaaggggatcc

SEQ ID NO: 7886 - DNA, 363 bp, Diabrotica virgifera
  Clone ID: LIB3026-023-Q1-E1-D9
cacaaagttgatacaggtcttggcacaacataaacacaccattccccaagaattggtttcccaatactttgctatttacacccaaatacttcaattgatccaacacggagatgctgtaccccaagaattgatctaccaacaaagacaaatccaccaacagatcgtactcatgctccaacaattgaaagttgttccccaacaattactcaaccaactcatgttcaacacacaaggccgtatgtggcaaactcaaggaacctaccaaagagtaccaatcatggtgcaaggaacctaccagagagtaccactcatgatgtaaagaccggtttatacttaatacgttgtttaaaatatctagtgtta

SEQ ID NO: 7887 - DNA, 151 bp, Diabrotica virgifera
  Clone ID: LIB3026-023-Q1-E1-E1
gtccgcgaacgaatgggatttactccaaatacacacgtttaatacacgaattccgcaacatttttttcacctgtttactaaaaacatgtccttttgtactacacaccacatctcgcccgcccagggattaccttgaagggccgcggtactt

SEQ ID NO: 7888 - DNA, 315 bp, Diabrotica virgifera
  Clone ID: LIB3026-023-Q1-E1-E2
cctgtgtagaaatatatttttagattacaacgttttttaaaacacacaaggtccttattaaaagccaagacattctcagaataaattactgacaatcttccacttctcaagcgctagacaaaattggcgttttgattttccattatgtgaaaattttcctaagacagtttaatgtgcagatttactacataaaatagtagacccacttttaactgaacatcgcgatcaagaaactgacattcaaaataaagttacccctgttcgaaatgtcacgaattcgttcccgaaagagtcacctggcttttgcaacatgaa

SEQ ID NO: 7889 - DNA, 236 bp, Diabrotica virgifera
  Clone ID: LIB3026-023-Q1-E1-E4
atttaaaaactgctaatacatgtttaacagaacatatggatcctattctgatggatttagggtcttgcgctccaccgaaagttcaagtttgtggagctcaagatgcacaaaaattgcaagatttggctgccgaaacatgttctatcacatacacaactcctgaactattccatggttgagagctactgtgtaattgatcagacactttatattttgagtttgggttgtgtcttgta

SEQ ID NO: 7890 - DNA, 233 bp, Diabrotica virgifera
  Clone ID: LIB3026-023-Q1-E1-E5
cacgcgtacgaaaaacgaatcattttctaatattcctttgtagtacagtgaatgtagataacaactaactaggtactacatttatatttaaaaggtaatttcaagggctatgacgtattaaattgagtattagcacacacaatgtgtgtactttgtgcgcacataagacgttgtacttctattatacgatttcaaccacatccacatactttaaacacgtttatttatcccta

SEQ ID NO: 7891 - DNA, 304 bp, Diabrotica virgifera
  Clone ID: LIB3026-023-Q1-E1-F4
caatagatcacgagaactgatttttacatgcctaccattgaaaattgcatttaattgatcattttttcacaagatcctcgtttattgaagttatttactcgttgagtcagacattaccattaaaatacgtgaaaacgaatagattttccataactttttttcactgagctgtttcttttgccgcctcgcacattttttctctctttcacgtttttccctcactttgttcttgtagtccaagtgaaaatatcctgtgatttttgttcagacattttttgtgttttcagatagttttactgtttta

SEQ ID NO: 7892 - DNA, 354 bp, Diabrotica virgifera
  Clone ID: LIB3026-023-Q1-E1-F6
acgcgtcagccagcgcgtccggataatttcaagctttatttaatcatttgactatctcaagatactttcggaagaattgcgacgcctaaaaatgttgctggttagagaactcttttcatcagtcatcactatccggggattgaatcgaatcataaattcgattctcacttcactctttaagttcataggcaaaaatcccctataataagactgtaggataatcttgaggattttgctctaatattgaaatggcttacgatgatgatttaaaagtgacttgcttccattagaagatctaacctagaatgtactggaacatagaactactagaataatttctaactaagtagcgga

SEQ ID NO: 7893 - DNA, 236 bp, Diabrotica virgifera
  Clone ID: LIB3026-023-Q1-E1-F9
ctccggaaactctggaggccctctagttgtgaatggtgtacagatcggtattgtgtcctttggttcatcgattgtcataattgattgcactctcattcatacggagttcattcttccaggaccggattgcatatcattcggaccttttattttaattcttgctcatctaattctttgttaatcattttatgatccaccatggtggcacgggatgcagttcgctaccatcatttaat

SEQ ID NO: 7894 - DNA, 333 bp, Diabrotica virgifera
  Clone ID: LIB3026-023-Q1-E1-G1
gtccgatattttattgtaaaataaatattttaaataatttttttgtaatgaaatgttattcgtttttaaatatatctaattttttaagaaataaattaaatttatttattaacaatatatttatagttaaatatttttatattattaatattaaatatttttagggatgagcttaaaaataaaattttattaaaatttaatttttaaatcaaaattaggattaaaaattttcacatttcaaaatatgttattatttacttttatatattattagttttaccttttataaattttttactacaatatacacttaaactatttaaatttagtaac

SEQ ID NO: 7895 - DNA, 370 bp, Diabrotica virgifera
  Clone ID: LIB3026-023-Q1-E1-G11
cctccgcaactttctaaaaattcttgtttttccgacattgctagcttttggtccttatgattactataaacttttaatgtgagttataaatgtaatattcatgtctacaataaaattaagaagtgttaaatgtattttcttattgttgagtactgtaagagcaacatgaaaacactgaattgaatcgaattttgtccatgagatttagaaagtcatccttcctatatacaccatttacattatatatgacaatagtatttttattatctttttggatttatataaacctagtgacttgttgttcaagtagtagtacaataattgttaaagaaaatgtagccttgttacaagaaattagggtactcgaaaa

SEQ ID NO: 7896 - DNA, 118 bp, Diabrotica virgifera
  Clone ID: LIB3026-023-Q1-E1-G2
ccttcattgccaacacagtactcgatcccaatgtccacgctgtagaccacgttgattggagagaacgtgctgttttgggagtccaccatcggggacactctggatcacgctgggcttt

SEQ ID NO: 7897 - DNA, 142 bp, Diabrotica virgifera
  Clone ID: LIB3026-023-Q1-E1-G5
acgcgtcagatattgctgggctttcagtatcatgggatccctcgaaggttaactcgtcatcgataggtatcaacgctgtttctctcagtgagcaagaattggttgactgtgattgggtgagggagggttgtgacggaggttt

SEQ ID NO: 7898 - DNA, 343 bp, Diabrotica virgifera
  Clone ID: LIB3026-023-Q1-E1-G9
ttcccgagtgcccccacgcgtccgcccacgcgtccgagttagtttagtacgaggtctatttgtcccgttacgcagctaaggtgttaacttacactgctgctgttcataacccatcagaaaaattgagaatgtgcaatgtggttgatcaattccccattaattctcaaccaacaactactaaaaacagttacatgatttacgaaggtgcaagataactgtcaggccaatttttcagcgtccaacactcatttctcttgtacaaaaattaaaaatacgtgggcgttaattaaaattatcacatatttacctttcgcgcccgtcttagtaattttttgacaatttt

SEQ ID NO: 7899 - DNA, 219 bp, Diabrotica virgifera
  Clone ID: LIB3026-023-Q1-E1-H11
cacgcgtccggtactacgtaatttaactgtctataaatgttattgcgcttatagtatagaaaaatattgttaagccacagattaagcaggtattgtttgccatatgtacctaatatcagcagcattcagctcttcttaatatctgtaaactatctaatttctagttgtaatcaaaatgttttcaataaattttttatcggaaaaaaaaacgacaataaa

SEQ ID NO: 7900 - DNA, 66 bp, Diabrotica virgifera
  Clone ID: LIB3026-024-Q1-E1-A1
tccggggtcaccacgcgtccgaaagccgactataaccaagaaaatcttctcagtttttgttatttt

SEQ ID NO: 7901 - DNA, 255 bp, Diabrotica virgifera
  unsure (1)..(255): unsure at all n locations
  Clone ID: LIB3026-024-Q1-E1-A10
tccggaaactactgctttgtgtgttttcnggctatctttgttttcgctggctgttcttctttttcttgttgtgttggtgcgcttttggtggctgtcggtctggttggccctgttgccgtgtgtgtccgtgctgttgtctgctggcggctgtggctcgggggtctccttgttgtccggggttgcccgggtggcgctggttttgtccgtgctgttttcgctgttgtgttctggttcgtgtcttggttttgctttttg

SEQ ID NO: 7902 - DNA, 250 bp, Diabrotica virgifera
  unsure (1)..(250): unsure at all n locations
  Clone ID: LIB3026-024-Q1-E1-A2
gtccgcaaacgcgtacgggccataggcaggttagacaaggtaccgaatgtccgggtgacaagctcttcagagacatacacaagtggcagaatttttgtgaacaaccagacgagagancagtagggacaaacaacacttggttccttagaaaaactgtacatgacaatagtacggataaggaagagcgagatgaagacaataatgacaatggtattaataggttagaaaaaagaactgtttagatttaagt

SEQ ID NO: 7903 - DNA, 306 bp, Diabrotica virgifera
  Clone ID: LIB3026-024-Q1-E1-B1
caggcgtccgcaaacgcgtccggaacttttcctttcaccgcactatgcaggaaccagcgagatgaccaggacgcaggcagtctggactggaagagtcagcgcacaggagagccccactgacgtaaagcctagcaccactgtagacagttttaccgtcgactggcacgttgcagatgtggcaggtccaatcagtggtgtcggattacttggagacacttatgctctcgctattcacgaaggtattgaatgtgccctcaaccatggtcgtatcgcaaataccgttggagagttccttaagatgagatt

SEQ ID NO: 7904 - DNA, 427 bp, Diabrotica virgifera
  Clone ID: LIB3026-024-Q1-E1-B11
cggggccacccacacgtccggattaaaccaaaatggactggaagaatcatggcacagaaagtccccaccgtcttaacacctaagcccattgtagacagttttaccgtcgactggcaagttgcagatgtgaaatgcaaaatcactggtatgggaataattggagacacttatgctctcgctattcaagaaggtattgaaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcagcctcaacagctgcaccatgcacttatgcagcaccag

SEQ ID NO: 7905 - DNA, 257 bp, Diabrotica virgifera
  Clone ID: LIB3026-024-Q1-E1-B2
ccacgcgtccgacaatgcgtgggtttaaagttaataaacagttttcgagtagaatgtagggaaaaattgtagttgagggacagttagtaagtgttgtgagagaagattttagttttatgcgagaagagttcagtttttgtacgctgtgtatcagggattagtagttaacaattagatgtgaattatttccgagtgtgggggagctaacaaagtcagatttttattgtaaaggagcgaggttaaagagtttttttgta

SEQ ID NO: 7906 - DNA, 112 bp, Diabrotica virgifera
  Clone ID: LIB3026-024-Q1-E1-B3
aggtgttagaactgccctcaacactggactcatcggaaatgtcgttggagatttccgtaaaatgagatgcagcacggggtggtaggccactggcaaactctgggatcttatg

SEQ ID NO: 7907 - DNA, 213 bp, Diabrotica virgifera
  Clone ID: LIB3026-024-Q1-E1-B7
aattttattgattttaaaatagtaaaatgtttttttactgaaagtacagacgagttttatttaatgatagtcacgtagtattgtgagacaatattttatttttagacaagacaagtttattttttgtaccttgtgtgtcagggattatgaatgactaattcgccgtcgattacgtgcgagttgaaaagagctaaaacattaaaatttttattg

SEQ ID NO: 7908 - DNA, 251 bp, Diabrotica virgifera
  unsure (1)..(251): unsure at all n locations
  Clone ID: LIB3026-024-Q1-E1-C3
gtccgtaacanncatggtagtgttcttcgcagccactgtgtgtgtgtcacccagcgtgcaggtagctcatctgacgcttatcctgttttatgaaggattatgccctggttgtcatcaatttattctaacacagctatatccttcatacgcgaaattggcagatagcttgagatggcgctttggaccccagggatggagtgactcttcacgtatcacagatggaaaagtggcatttgaatgccagcatggtg

SEQ ID NO: 7909 - DNA, 228 bp, Diabrotica virgifera
  Clone ID: LIB3026-024-Q1-E1-C5
cccggggccacccacgcgtccgcaaaagatgaagatcgctatcgttgtttgggcccttgtggcacttgcagtggctaggccgttagaacaaagcccagagattaagtttatggagaaaggcattacgtggagagggaacaactactcgttattgggattgttgcagagcttcctgctcatggacgggaaacgtcgagacggcgggcggagtaccggttgcgtcatgcg

SEQ ID NO: 7910 - DNA, 297 bp, Diabrotica virgifera
  Clone ID: LIB3026-024-Q1-E1-C9
gtcccagatccccggggccacccaaacgtccgaaaaaattaaaatttttattgtaaaataaatattttaaataatttttttgtaatgaaatgttattcgtttttaaatatatctaattttttaagaaataaattaaatttatttatgaacaatatatttataattaaatatttttatatcattaatattaaatatttttagggatcagcttaaaaatacaattttattacaatttaatttttaaataaaaattatgattaataattttcatattttaaaatatgttattactcactt

SEQ ID NO: 7911 - DNA, 371 bp, Diabrotica virgifera
  Clone ID: LIB3026-024-Q1-E1-D10
ccggggtcacccacacgtccgcacacgcgtccggaataacattatgttgttttataagccattacagtgaaaacttaatcatttatttgtttgttgttcataaatttttatatttaattcattatcaaacggtaggttttgttgtttgtgacttcagaatcataaaaatttcatgctagaattgtcaaaagcacaatacttaattttttaaggaagtaggtgcaaaatcttggtccaattctattgaaatgcattaacttttttcgagtactgacaatactaacgaacattttcacgggttttacacatatttgataatctttttagaatttatcatattacattatgcctgagggcctaaagtcccttac

SEQ ID NO: 7912 - DNA, 262 bp, Diabrotica virgifera
  Clone ID: LIB3026-024-Q1-E1-D11
cccacacgtccggatgtttattttcgataggagcagaattattatcgattttttattttactggtatgatatgagaacatttattttatttagtgtgaaagagcttagccattttttcatcaaaccagctttattaattatttaagtctcataaaaacgaacatgttgcttttgcaatgcccaatcaaaattgtaccatattatgttaacaagaaaaaataaatattattttttaaaaaaaaaaaaaaagaaacaaacgaaa

SEQ ID NO: 7913 - DNA, 221 bp, Diabrotica virgifera
  Clone ID: LIB3026-024-Q1-E1-D3
gtccgcaaagattattcagtaacattaccagtgttaactgattttgtgtgagtagttacatgtgagtgtgactctcttgtagagttgttactctcttgtgatttttacagaggttagaaagtagtgtattacaggtatgaaagttgattaatttttgctgtatttactaggggacgtaggtgtgatcggcgtatctcacgcaactttagtgcacgactatc

SEQ ID NO: 7914 - DNA, 217 bp, Diabrotica virgifera
  Clone ID: LIB3026-024-Q1-E1-E5
cacgcgtccgcaaacgcgtccgcccacgcgtggggaaaggttattcgtgtttaaatataggtaatttttgaagaaataaattaggttgatttagtagcagtagatttataggtaaatatttttagattattaagatgaaatattttgagggatgagcttaggaataaaatgtggttaaaagtgaggttggagataaaaattaggattaaaaattttc

SEQ ID NO: 7915 - DNA, 86 bp, Diabrotica virgifera
  Clone ID: LIB3026-024-Q1-E1-E6
ccacgcatccgcagacgcgtgggcggacgcgtgggcggcggcgtgggacgagaagagtttagtttttgtggcgtgtgtatcaggga

SEQ ID NO: 7916 - DNA, 159 bp, Diabrotica virgifera
  Clone ID: LIB3026-024-Q1-E1-F2
gtccgtaaataccagtgctggtaatattagtcacaaattaaataattgtcgcgatattcgtgatatacgaggtttaattacagcctttaccattgacttgtatttacttaaatacttgtaatctttctttatgtggttttccttttagatccggatttt

SEQ ID NO: 7917 - DNA, 87 bp, Diabrotica virgifera
  Clone ID: LIB3026-024-Q1-E1-F3
gtccgaaaatttgtattgtggaataagtattcgaaatctgttttttgtcctgaactgtcacgcgtgttgaggtatatctacgttttt

SEQ ID NO: 7918 - DNA, 353 bp, Diabrotica virgifera
  Clone ID: LIB3026-024-Q1-E1-F5
ggggccccccacgcatccgcagacgcgtgggctgttgttctgtatggtttgagccaggatccagaggcttcttgggaaagtggtgcacttgcgattatcttcctagtgttcttcgtcggtaataccatcacaacgttacgtgttattccaaagaagatgaagaaaaatatgtacatacagtagaagatattgtcgaacaggttttatgagacaatcagcgattctgtaagaaaagagagttccaaggatagtacaaaaaaagaaagtgaggtacagcagcaatgaatttggttgtaagggatatttttaggctaatattcattttgtttaagagagtgtcatatgagttttat

SEQ ID NO: 7919 - DNA, 434 bp, Diabrotica virgifera
  Clone ID: LIB3026-024-Q1-E1-F9
ggtccgacgttcccggggccacccacacgtccgaaaggttggatgaacacaaaactgtccttatttgacttatagagaattttattttctaagtgaaaaagcttaaatttttttacaacacgagaacacccgacagagttggagaaaattatcaataagtttttgtagtagtaacttcatctatggagcaaactcattcaactggggtgattaaggtggagctttagctttggtcatattatactattacttaacaatgtttgtgatccaagtttttcgatgacaagaataactcacctcatggacaacagcctaatctaattggagagtgcaaatcgataccaaacattgcgacctcgacgtcggaccatacttgataaatggtgtaccagctatatgagtacgtctgtacgacctttaaaatctcacaggat

SEQ ID NO: 7920 - DNA, 429 bp, Diabrotica virgifera
  Clone ID: LIB3026-024-Q1-E1-G10
caaggttattcagaagtaaggagaagaacatttggcataaaaattgacagattattttttgaaaaatataaatataatgtataatattgatatttatgtaatgatcattaaatgtaaaataataagagtgtatgcatgatattttggaaaaatacatatgatattggacaaattttctccttattgttgaattcgcgacaggcatatagaacatttagctttgttttttattcgatgccatcttggacgaaatatcacatttcatttctttgttaaagtaaaacgttgatattaaaagttgtttattcttgtaatattgtataaaattgattgttcgattagggcaatgttaagatcaaatttctatatacctgtcgtttggttcgagtgaacaaatttgataaagtgtgtgattagtttttaaggatc

SEQ ID NO: 7921 - DNA, 277 bp, Diabrotica virgifera
  Clone ID: LIB3026-024-Q1-E1-G11
tacggtccgagcattcccggggtcccccacgcgtccgaaccgttttggctacccaagaagtcagcgccggtgctgtcaaaggtgcagaagctcctcgtgctgctggacttggagcatactgcgaatgtaacgcatgcagtatagaatgcatatccgatagctccgactacattggaagtttttgttaccaaggccaatgtgtttgtgcctcccttggctaaactaaataatgtgataaagtttaattaataaagtgttaaattgaaaaatcaaacga

SEQ ID NO: 7922 - DNA, 388 bp, Diabrotica virgifera
  Clone ID: LIB3026-024-Q1-E1-G12
cctttggtaccggcaagcaagtcaccatcaacgacgatggcactctcaccatcttgggagaaaatggtaagaaaatcgtcatctcaaacgccattggaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaaaaaagacagcaaaaactccaaagacaccaaagagtacaaacgaaaggaaggaaaatcgaaaactcaagctcaattacttcaagaaatcttcagcgaacaccaagaggcaac

SEQ ID NO: 7923 - DNA, 252 bp, Diabrotica virgifera
  Clone ID: LIB3026-024-Q1-E1-G3
gcgtccgccaacgcgaccgcccacgcgtccgcccacgcgtccgtgcttaccctcattgtaacagtatcaggcgggaggtacaattttgaccgtgtctttccactgttcaggtatccagtgctgacactttttacatgaagacaatcttgttttcgtcagtgcttttgtaagcaggtgctgctttgcagcaggtcgaattgacactggtagatctttctgaatctgatgacgaagctgtcttgttaaaacttt

SEQ ID NO: 7924 - DNA, 221 bp, Diabrotica virgifera
  Clone ID: LIB3026-024-Q1-E1-G6
ccacgcgtccgtatgaggcgagtgtcctgttacgaggcatgcattgactcgcagatcattcggatgcacagcgagtacatatttggacgttttcttcagaagttcatctattcgagtagttacgactcagttgttcgtaccaatagttgcgtgtcgtcggttccgccgagtgcgggaaccttctctcggcgtggcttctcccctggcaaggaagaaccttc

SEQ ID NO: 7925 - DNA, 133 bp, Diabrotica virgifera
  Clone ID: LIB3026-024-Q1-E1-G7
aaatcatggcatggagacatcggtgtttgtagcacctcgatcgaggtcgagagattgagacggtatggtcttgcggagtggaccgttacggcgaagcaaatcaggtgatgacgctgataatgtagcggtcttt

SEQ ID NO: 7926 - DNA, 160 bp, Diabrotica virgifera
  Clone ID: LIB3026-024-Q1-E1-G9
ccaaacgtccgaaaatattaaaataattattccaaatttaaaggatggctgttaggtttggatccgctttaaaggaattacggatacacctctgccaaactggggctgctagcaaaggagtcacagagtttatggaaaagcactatctacaagtaaaatc

SEQ ID NO: 7927 - DNA, 254 bp, Diabrotica virgifera
  Clone ID: LIB3026-024-Q1-E1-H2
tccgcaaacgcgaccgagagggaacttatcaaggccttcagactttagtagttacgaaaggtgtacgttgacgaataattttatttacgacttcagaggtattaggtttttagagcatttttttgaggattttttcacagatcattatgaccaactgttgaattaggaatacgttgacctccgagaggaaggcaagcctttaacccattagaaatccctttattaaatacttgagctcttttaacttcgggatt

SEQ ID NO: 7928 - DNA, 162 bp, Diabrotica virgifera
  Clone ID: LIB3026-024-Q1-E1-H3
gtagccgtccgacattcgaggctgcccccacgcgtccgatataaatgctggactgaacggttggacgagcgatcgactgtcttcgagtacgttacgacgcacttgagtttcacttcaacacgcttagacttttgtacgcgactagatcaccctatgtagttt

SEQ ID NO: 7929 - DNA, 373 bp, Diabrotica virgifera
  Clone ID: LIB3026-024-Q1-E1-H5
tggaaattgtgaaatgcgcccagcgagtgatgagcgtaggagtacctgaagtaggagttccaccacatgctcccttcgtcgctattagaaacgtatcatggactggatcaatcggtgttgcaagcactcatatcgagcttaataccaataaatggtatggccttgccgactgggatatctcagctaagcaaatcaatgatgactctgattacgaggctgtctttgactacaccacatactggcccacttttagaatcgtcggcagctacgaagcaaccgtgaaagagcttttccttacacagcactacaaaggaacctacagcatacgcatgattaagccacgatggactggaagaatcagcgcacaaaaagt

SEQ ID NO: 7930 - DNA, 163 bp, Diabrotica virgifera
  Clone ID: LIB3026-024-Q1-E1-H7
cacgcatccgcccacgcgtccgatttttatctattttagaataataccctcttttttagtcacagtgccgaccgattttatccactgatagtcaattactattgtgagagaagctcttatttcttacaaaagaaccatttatttcttgtaccttctgtagcag

SEQ ID NO: 7931 - DNA, 117 bp, Diabrotica virgifera
  Clone ID: LIB3026-025-Q1-E1-A11
ctcacgcatccgcagaaaaaacaaaataaaaaaaaaaaaagaaaaaaagtaaaacaaaataaaaaaccaagttataatgattacacacacaaatggaatgtgttgcaataatttttt

SEQ ID NO: 7932 - DNA, 366 bp, Diabrotica virgifera
  Clone ID: LIB3026-025-Q1-E1-A2
gtccgcccacgcgaccgaacggccctcaaccatggtcttatcggaaataccgtcggagacttccttaaaatgagattcaacactgtctggtatcccactggcaaagtctggcaaatgatggactggtgcaacggcggctccaccgacgccccaacaacagctgcaccatacacaaatgcaccctcaacagctgcaccatagacagatgcaccctcaacagctgcaccatacacttatgcagcaccagcccttttttaagcaaaaaattaatttacaaaataaccaagaatatattttcctccagctttgtaacgatagaatacaatacaatcgtatccattatttactacaagcacctcccacaca

SEQ ID NO: 7933 - DNA, 89 bp, Diabrotica virgifera
  Clone ID: LIB3026-025-Q1-E1-A5
cgtgggcggacgcgtgggaaaaacagggaataaacggataaggtaaatataagagataaaaaactaactaaaataagaaataggggggc

SEQ ID NO: 7934 - DNA, 197 bp, Diabrotica virgifera
  Clone ID: LIB3026-025-Q1-E1-A9
ctcacgcatccggacatggcccaaatcgtcttcctcttggttaaggattgtgccatggggtattacgagttatgctgaattggatgaaaactccatgctgagatgatactgatttacttattactgaaaatggtgtaccatatgacggttcttccttggacgatctcttcggaggctattattaccagcactcacac

SEQ ID NO: 7935 - DNA, 310 bp, Diabrotica virgifera
  Clone ID: LIB3026-025-Q1-E1-B5
atcgggtttgcaataagttctgaccgtttcaacgaagccatgactgtttgtttcgatagtactactaagcttgcaatatacacctattttgttctatcaaaatctataaattatagggctagaaaggttgccaacccttccttttcgcaagatgagattttttatagaatggggaggtctgtgaatgcgatgtaccaaagtatccagactacttataataccctagttggattagaagttacgtccacgcagtacgtcaatacacgtatttttccaaatagaggacatttggctgccaaagctgactttg

SEQ ID NO: 7936 - DNA, 70 bp, Diabrotica virgifera
  Clone ID: LIB3026-025-Q1-E1-B8
acgcatccgaagatcgtagacactggtatcagtttgatcgctggacctagcgctcaagtcgataagtcac

SEQ ID NO: 7937 - DNA, 373 bp, Diabrotica virgifera
  Clone ID: LIB3026-025-Q1-E1-B9
cacgcatccggaaggctacagtggacttggccattacggagtcttgccagccgctaccagttatagttccagtgttgttcaccatacacctgtggtcgctaaaacctacgttgcaccagtggtcgctaaagcctacgttgcaccagtggtcagctacagtgccccattagttacctcctatggattgggtcacggatacggaggattgagtcacggatacggaggattgagccatggatacggacatggtttaggatatggtcatggtctaggacatggttatggtttaggacacggttatagtctaggacacagctacgcaggtctgggtcatggttactctttaggagggtctggacctgggtggtacctg

SEQ ID NO: 7938 - DNA, 64 bp, Diabrotica virgifera
  Clone ID: LIB3026-025-Q1-E1-C3
tccggaattacctaattttgttatgtgttgacatggacattggaaataataaagattgccatac

SEQ ID NO: 7939 - DNA, 354 bp, Diabrotica virgifera
  Clone ID: LIB3026-025-Q1-E1-C4
gtccgcaaaaatgattgcttttgcagtaactttttgtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatactgcagtaggtgacgatagaactataaggagtcgtacccaatatatcaattcagagacatctgacagacacgtcctagaaggacaaacacaaggttcaacaactggggaaggcaaattcatcctacatttcccacatccagacgtaactgtaccttt

SEQ ID NO: 7940 - DNA, 362 bp, Diabrotica virgifera
  Clone ID: LIB3026-025-Q1-E1-D10
ccacgcatccgcattatcggcattcccacagcagtctcgaactcgtgatattcaaaagtcataaaaataatttactgaacaatgttttactaagaagaaactcattttctgctaaaaaggtttcaagagatagaaatagtgaaaaccgaagttttctgtcttagttgcctttcttagtttttgtttaaaacgatcacgaaactcaaactgtttgttggttcaaaaaactggtttccaactatatcataataacaaaacacaaggattgcagttctggagaatatgtgattaaaagtattaggggtcagcgtactagtgaccagtactatgctgcgtaccctagcacattcgcggtcatgact

SEQ ID NO: 7941 - DNA, 137 bp, Diabrotica virgifera
  Clone ID: LIB3026-025-Q1-E1-D3
tccgaaatttcaagggatgagcttaaggataagattttattaaaatttaccttttaactaaattttaggattaacaatttgcacacttcaaaatacgtcatcatgtatctttatatctgatcgggttcattcgtcat

SEQ ID NO: 7942 - DNA, 222 bp, Diabrotica virgifera
  Clone ID: LIB3026-025-Q1-E1-D6
ttttaagaaataaattaaatttatttattaataatatatttataattaaatatttttatattattaatattaaatatttttagggatgagtttaaaaattaaattttatgggaatttaatttttaaagtgatgattaggattgggatttttgatattttaatatatgttattatttatttgttagatattgagtagttttatggttttattagattgtttat

SEQ ID NO: 7943 - DNA, 421 bp, Diabrotica virgifera
  unsure (1)..(421): unsure at all n locations
  Clone ID: LIB3026-025-Q1-E1-D8
ttttnttttattgttttattttttagtagattttttgtttttttttttttattgtttgttatttggtattgttttatttttttttatttttattgtatgatttatgttttggttgttttttttttgttgattgtatttattagtgtgattatttatttgatttatttgttttgtatattttgttggattgtgttatttttttgttttttgttgttttttttttggttttttggttttttttttgtattgggtgtgtttgtttatgtttgtttgtgtttttttttttttttttttgtgtttttttttgattttttgttttatttttattttttttttttagttgttgttatttttttttttttatttttttgttttttttggttgttttttattgtttttgtttgtttttattttttttttt

SEQ ID NO: 7944 - DNA, 115 bp, Diabrotica virgifera
  Clone ID: LIB3026-025-Q1-E1-E11
cacgcatccgtatttatttattttaaaataataaaatattttttagtaaaagtaaagaaaaattttatttaatgatagttaattattattgtgagagaatattttatttttataa

SEQ ID NO: 7945 - DNA, 389 bp, Diabrotica virgifera
  Clone ID: LIB3026-025-Q1-E1-E12
cacgcatccggatttttcttattgtggcacaaagcgctttttgtgccccaaaagataaaaaacacaaaagcaaaggcaaatataaaacttgggttgatcaaaaccaagtagaacttgagggcgccaaaaacagagtcatcaaatacatacagaaaaatgaccccgataccacaagggcaattaacgaactactacaaccagtgaaagacaaatgtccacaggtcgacaaggtaccgaaactcttggatgacgtatacggttgtgtgaaaaatactacagtaggttcaggcactgtgtgttcaacaattcagaaaactatcgaaaaatgccacggacctttaaccgatcctgtcggaagctgttcgcccaaagaatccaacgaattgccc

SEQ ID NO: 7946 - DNA, 108 bp, Diabrotica virgifera
  Clone ID: LIB3026-025-Q1-E1-E6
cacgcatccgcataaatgtttgtccctaacatgctcttggtcctgggctttgcccttttagcctcagctggaaaagagcttgattctggcatggaagttttgagatcc

SEQ ID NO: 7947 - DNA, 283 bp, Diabrotica virgifera
  Clone ID: LIB3026-025-Q1-E1-E9
ccacgcatccgcacacgcgtccgcccacgcgtccgcaacaagttcatgaagtaattgaacgtttgacctcccaacaaatattcttgaatcatctagccgaaagcactgaagcaactgaagtcgatagtatttccattcaaagatgggttgtacaacagaatattattaacgagcagatccagcaattgatccaacaagttttgtatcaacacactcacgtaaggcatcgaatccaggtgccaattcatcaaggatatgttatcccacaggaactcgtccttta

SEQ ID NO: 7948 - DNA, 94 bp, Diabrotica virgifera
  Clone ID: LIB3026-025-Q1-E1-F10
ccacgcatccgcacacgcgtccgaattctattcaggtggagttttcaacaataaaaattgccatgtatcagcttcgacagctattgacactgga

SEQ ID NO: 7949 - DNA, 339 bp, Diabrotica virgifera
  Clone ID: LIB3026-025-Q1-E1-F11
cccacgcatccgcacacgcgtccgaccgtggacacgtgcaaatggggcggatatttttagtttttgttttagtgggggctgcttttggaaacccagcgccaaacttgggacaggaaaatgagtgggagcagcttctaaaagttggttcgaacgttgatatcaaaagcaacgccattgacactggaagaagtgctgctggcagcattgaggaccacatctaaagatatatcaaaagccatgaagcaacgtttgatttgccttttactggatcaacggtgacgttagatggaaaaaatctggactattacgagatgagcattacgtcgacttttggcacac

SEQ ID NO: 7950 - DNA, 58 bp, Diabrotica virgifera
  Clone ID: LIB3026-025-Q1-E1-F2
atattttaaacagttattatttatttttatatacattacttttactcttataaatttt

SEQ ID NO: 7951 - DNA, 224 bp, Diabrotica virgifera
  Clone ID: LIB3026-025-Q1-E1-F4
gtccggagctttaaacatttgttcagaggtacaaagctgatatatcatcagagcaaaaagaagctttattggagttattaaagaagcaaaatcaccatactcttactcctgaaattagaggagagttgcagcatgccaagtgtagagacttggaagatgttatgcccacaatggagtttgattaaatactaaataagtagttgttaacagttatgttttgaagt

SEQ ID NO: 7952 - DNA, 400 bp, Diabrotica virgifera
  Clone ID: LIB3026-025-Q1-E1-F9
ccacgcatccgaacttacatctcatctacaaacaacaacttggacaaggtagtgcttaccgactaaaccaatacttggttagccaaagacaagttaatggacaacttagactcaccgttcctgaacaattcgttaaccaagacgtgttaaatcaagtgtacagcgaagtatccttagttaaccagagagcacagcaaattgtagaacagaatcaacaagtttctcaagaaatatctgtccaacagtatggtttgcactaacgtgtagatcagcttatccattcattggtatatcaccaggatgtgatctctcatctagttgagcaattcattcagcaaggaccacgtcttcgccaagacttgccttcccaactggtttcactccacccctaggttcgcca

SEQ ID NO: 7953 - DNA, 228 bp, Diabrotica virgifera
  Clone ID: LIB3026-025-Q1-E1-G7
ccacgcatccgaaaagatggagtgacgaatagagagaagggaaagaggaagaacaagaagaaggaagacaaaaaacatttattggacgacgagtcgattgttaattttaaggcaatacctttgacggctgttgtgtaagataatattccatgtggagtatagactacatatattttagttttttactgttctccagattttatcgaatatacttttatagtttacata

SEQ ID NO: 7954 - DNA, 316 bp, Diabrotica virgifera
  Clone ID: LIB3026-025-Q1-E1-H1
ggggcaacatttagaagagaagaagaaataatagttcttgtgcttgcttggttataaaataattatacaattagcttaaatgatacaatattgaagaatattaacagtttgatatgaattccaccctatttgatgtggttaggacagcagctttgctagttctcacaccaaaatgttttgataattactttttagaattcaactatttagacgggccatgtttttttgcaacattgagcacaggtctaggatttggaatcattttgggattcctgacagttaaagttcctcaaattctcaaaatcctcaaccacaa

SEQ ID NO: 7955 - DNA, 122 bp, Diabrotica virgifera
  Clone ID: LIB3026-025-Q1-E1-H10
ccgcacacgcgtccgtgacttcacagtatattgatttcactttgtgcacacttcttcgctaaccagttgtgcattgctgtcaattcttttacttgtccatggcatatccttgggcaggagct

SEQ ID NO: 7956 - DNA, 336 bp, Diabrotica virgifera
  Clone ID: LIB3026-025-Q1-E1-H11
ccacgcgatccgcaaacgcgtccgatgaaactaatgttattcttttttgtcgctttaaccgtagtggcatctcaagcagaagaatttaacgttttcgagaaatatgtagaatttgtaccacaatgtaattctactctatctaatcaggcttttaaagattttatgactaaaaaaaatgcgaatttgggtctagaagaactaggaaactttttattttgcatgaatacgaaatttctcactcagaatgaaaacggagacgttaatgttcaacaattcaacaaaattgttggtacgctagtacctcaaaatgacttagaacacttaacaacagtgtgt

SEQ ID NO: 7957 - DNA, 414 bp, Diabrotica virgifera
  unsure (1)..(414): unsure at all n locations
  Clone ID: LIB3026-025-Q1-E1-H2
tccgaaaannttattattgaagtataacacttctataacgagacatacttggttataacgagggaaatatgatcgacgaacatgtttctttagttgtttttgacgtggtgatggctataaataaatagctgtctgtatacaaatgaaatgtctaatatatgtgtgcttatcgacgccagtgatgtaataaactccaccgcctgtcaacttcttagaagttaatgttttagaaaactacatattcatatgtaggcacaatattattgttgtatgatataacgaggtaattagtctgccatttcagttttcgtttagaaggggtctactgtacttttagtgttgtgttctaaactggattcacagtgtttacgaggtatcgagactatattacgagattttttagtttgtggttgt

SEQ ID NO: 7958 - DNA, 419 bp, Diabrotica virgifera
  Clone ID: LIB3026-026-Q1-E1-A12
cccacacttccgcccttgcttcggacttcattcatctgcgccatcatagtcatcggcctgaccgtacctgttctgacaggtttaggtcttcgctttctctgtcatagaatgtgagtgtgagaatctggtgacaggctaactagacctgctagagtagtggatcagggtagttgaccatattgctgataatctcaagctgcaagtataacacgtcaggtcatcctggtaaccgtcgtaatggcgtacatgctctcaactgtgatgtacccgggacgctcaaatctgattgctgttttatacattaggctgaagtttgacacaatatcatttgagacgtgttgacttctctgcatcgaggacctttggatttggatgtcaagattacatcgatcgtggtatctaatatgatccaagtatag

SEQ ID NO: 7959 - DNA, 422 bp, Diabrotica virgifera
  Clone ID: LIB3026-026-Q1-E1-A2
agttcatgacaagacacgataattcatcattcttcagtgcattttcgcagtgataaaaccaatttttgtgaaatgggaaatggttttttaagtttaatacacactttatattgcgtgttcttcgagtatctttaagactttaaaaggaatagtattattaattcttagttcctaactgaaccggtgccgatagcaagactgtgatattttttaaaaaataaataccaaagatgtcaacggaggtgaagacgatttctgcgagagccattacgatactaagaatggaagaaacacagccaagactgaccagatcatcgtcgttagataaaataaagaaattcaacacattcatctgctcccaacagtactacgtgttgccagctctacttaattggctaaaatcttcacaaaccaatctacaa

SEQ ID NO: 7960 - DNA, 402 bp, Diabrotica virgifera
  unsure (1)..(402): unsure at all n locations
  Clone ID: LIB3026-026-Q1-E1-A4
ccaacgcgtccgagcaatttgaaaaagtcagtcatgaaactgaaaatctttaggcaatgaggtattttgagcttttcttcacttcatacatttcaataaaaaatattttggacatttgtcaaacgggttaagtcgtanacgaaaagtggctcaaaccttctttttgcaaaaaaatggccggtttgccccgcaccaatcaaatgccccctttgttggtgaacttttcgcaaaaaatccttgtttgtaaaacttaattaatttgttgggaaattattttgaggaacttttggtaaacttttaaatttaattttttaaattggaataaatatcacccccaatagcatcgataatttataaaccatgggaaaaatacaattcacatttaactcatatcgatttatt

SEQ ID NO: 7961 - DNA, 255 bp, Diabrotica virgifera
  Clone ID: LIB3026-026-Q1-E1-B7
agttcgtttatagttttttaaatacgaatttagacagcaatgacaggtatacatgtgcaggttccatcaggagcgcaatatccagctctgtgtccttggcctctacatgtatacctgtcattgctgtctaaattcgtttatagttttttaaatacgacaattgttttttatctctaggcctacggtaaagactgtctaatttgtacatagttggtaatatagaataaaatgtaaaatcaatagaaaaaaaaacaa

SEQ ID NO: 7962 - DNA, 416 bp, Diabrotica virgifera
  Clone ID: LIB3026-026-Q1-E1-B9
agagcatattgttacgagatgaggttatgtaagataattgatataataaaacttttatatcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccccccaaagggttcaaacctaatttacccttcaaggcaatttcaaacccctccaaaattgcccccaaattcaattccaggggccttcttttaaaaagttcttaacgggaaaaacccgggcttaccccaattaaacccctttgaacaaaaccccctttccccaagcggggttaaaaccaaaaaggcccgcaccagttccctttccaaaagtttccccacccgaaagggcaaagg

SEQ ID NO: 7963 - DNA, 151 bp, Diabrotica virgifera
  Clone ID: LIB3026-026-Q1-E1-C2
cagcgtccgcacaagcgtctgaccacgcgtacgaaaccacttgggcagaactagcaaaaatctcttacgtgacacgtgtctttgacgaagtacccaggggaagtcctgttgtgccccacaagacacatggatgaaccaattccttaagacc

SEQ ID NO: 7964 - DNA, 352 bp, Diabrotica virgifera
  Clone ID: LIB3026-026-Q1-E1-C4
accacacgtccgcggacgcgtggggaaacatgaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataat

SEQ ID NO: 7965 - DNA, 122 bp, Diabrotica virgifera
  Clone ID: LIB3026-026-Q1-E1-C5
acccacgcgtccgcacatgcttcgacttaaaactggtgtgacccatgttggattccatccttaatttagtaataaagtttagtaccatgggaacatatatatatgaggggtgttatatttag

SEQ ID NO: 7966 - DNA, 426 bp, Diabrotica virgifera
  Clone ID: LIB3026-026-Q1-E1-D2
attgagcattcatactgcgaacaatatgattaacaaaagtgtttttacgatattcttgctgggggttatttctttggcccagggattcaatacaaaatattttgacacagaatttcttacgtccaatgggaagttgaaattggctaagctagtaaaatatgaacctgaaaagtttgataattatggagtttctggaattacagcaaatatgaatgaatatgcagaaaaaattttcttcaatatcggaaggtatgctttaacccatggtcttgaccctgtcaatattgcaaatgtaactgaagattttatgctggcatcaattaagtttaaaaatggtaaacttcacggaatatccacactaaaaagatatcaggacgtgctagctaattacgtacattccagtaggactttaattgtcactttacc

SEQ ID NO: 7967 - DNA, 402 bp, Diabrotica virgifera
  Clone ID: LIB3026-026-Q1-E1-E6
aatttttatttattttaaaatataattatattttttagtataagtaatgataaattttatttaatgatagttaattagtattgtgagagaatattttatttataaaaaggattattttattttttgtaccttgtgtagcagggagtattacttggaatttaaatatttattattttcgaatttaatagagctattaaattagcatttttattgtaaaataaatagtttaaataatttttttgtaatgaaatgtgattcgttttgaaatacatctaaatttttaacaaatttattaagtttatttattaacattataattataattaaatatttttatattaataataatatatatttttagggatgagcttaaggataagcttttattaaaatttaaatttt

SEQ ID NO: 7968 - DNA, 423 bp, Diabrotica virgifera
  Clone ID: LIB3026-026-Q1-E1-F10
ctgaatttagaaatttatcatttgcaaaacctacgaccagccataacgacaccataattcgtattacagcatccaatagttagatgaattaaagaacagcacacgcatttataaattcctttataaatttttgtttttcatctcattttatccgacactagcgaattggcaactagagccagaaacaaaagtatggatgggatggcttaagagagtactaagcagtccatttttggtataaaattattgttttcgcccaatttacaagattaaaatttgaaaaccttgaattatccatatctgtcggtccgtccgtaaacacaactcatcgattattagaacagatagaacgacaaatcaagtgtcgaatgagagcttttaacccatggattaaagatgagaaatttgtcctcggacttcctg

SEQ ID NO: 7969 - DNA, 412 bp, Diabrotica virgifera
  Clone ID: LIB3026-026-Q1-E1-F12
agcccacgcgtccgaaataatgaagaaagaagagtccaaaatactgcaaaaattcagaatggtcagatcgcctacataaaaaatgaaaacagttctcttgtgtataatattatgtatattagattcgttctcggaaattaatatagtttgttgtattgctcataatatgcctatttatactaaaaatctgtttgtgtcaaatccaaattccaagcggaagtgttaagtttttatttttcataattacgggataatattcccttgtctttaaaaagtttctatacctaatgtgccttttattaaatctgtttaacaattattattcttctatggagtgtatgaggttattgttataaaactgaaattagtttttagttagtactgtatttattagcttttaggttataataaa

SEQ ID NO: 7970 - DNA, 420 bp, Diabrotica virgifera
  Clone ID: LIB3026-026-Q1-E1-G1
aaatgatgcaaatgcagaaagtaatgctgatgcccaaaatggtgctgcacaaggtaacgacaatggcgctgctgcagaaaacactgaaaacgctgatagccaaaacgacgctgcacagaataccggcaatgaagccaacgcagaaaacaatgcgaatgtagatgttcaaaatgatgcagcacaaggtaacgaaagtcaagctgctgcagaaaacaacagtaatgctgatggtgcccaaaataataataatggacctgctgaagaaaataattctaatgcagatacccaaaatgatgctgcacaaggtaacgaaaatgggtctgctgcagaaaatactggtaacgctgatagccaaaacgacgcaggacaaggttccgctaatgcagccaacgcagataataatgctaatacagacgctca

SEQ ID NO: 7971 - DNA, 388 bp, Diabrotica virgifera
  Clone ID: LIB3026-026-Q1-E1-G11
gtcaaatactcatcaaaagatagatccaggattgtgttaaagaaaactgactcatttgctacatatattttgttttgaatgcaatgtttaagagaaattctgctaaagtggagttggaaagcattgcagcattccttagtaaatgtttacagactaaaatttatataaacaaaactaacattgatcatttccttgaagttatatcaatttgtctgggtgagcattgcacagtatggaaaaaatcaaatgtagatgcacgcaagcttttagaaaatgtgatcaattttacacacagcatagaagttgctgaaactagtaggatcaaaatgattagtatattagcagactttgatgacagtccgtatcttacaaaagccatcgggtatca

SEQ ID NO: 7972 - DNA, 411 bp, Diabrotica virgifera
  Clone ID: LIB3026-026-Q1-E1-G12
ctcaaaatatcgttttcaataaaataaaacacagtacatagttattaggattaattatagtgataaacgtgaaaacttattcaaaatttatttaatttttatatttgatctcttggcatctatttcaggttcaggcaaattttgacaagatttagcaaaagttaaagcataatcctaataccataatattattcttacatgatttgtatgcacgtgcagtatgaaggattctacattgtatcattcttaaatgatgcgaattaaacgcacgacactaatattaggattattgataataatatggtcatcaatattttatttaacatattattaccatcctgttcacatatatagtgaaatacctagtaaattgagccagcatattgtgatcttagaacaaggcatatcaag

SEQ ID NO: 7973 - DNA, 416 bp, Diabrotica virgifera
  Clone ID: LIB3026-026-Q1-E1-G7
attttggcagcgttgatttgaaaaaattctagagcaattcagttgtaataattgtagtaaattgcacaaatctattttaacttatatttaatttatcagtatattgctgatgtagcgaaatatttttaaagggatttttaatttggaaataattcgacctgtatatatgactaattaagttgttaacaaaaataataaaatgacaaccaataataaaaaatgttcttgttaatatacaggaagctcagttgagaagagttccttgacacctcaaattgcaagaacgtcttcgttgagcttcaagggattcttccgcaattatttggttgacagatttctacgtccactctataaaaaaatatttaaagtatgtatcccgaatctttattaaaatttcttagtagttcttttaaaaa

SEQ ID NO: 7974 - DNA, 351 bp, Diabrotica virgifera
  Clone ID: LIB3026-027-Q1-E1-A1
gggccacccacgcttcgggcaaaagagttacccacgtgcgcaaacctgtttcaatcgacaaaatcttcccccttatcaaagctacacacacttaaaggataagctaatcaaagcaatcgaaggttcacagggctttgcaggtgtctattagtatctataattaatctaaaatgttgcattttaccttaaaaaatctgtccaatactggtaacttaagttttaattatagtcgaatgaattatacagagattaaatattttagagctatatgtaacttgttgtttttactctgtatactttgtaaataattcaagtctattagtagatattaatcgataaacaagtcaaaaa

SEQ ID NO: 7975 - DNA, 324 bp, Diabrotica virgifera
  Clone ID: LIB3026-027-Q1-E1-A10
aggtatttcataactggcagtacattctacatatactctttaaatcgtattaaagatgtaatttattactgcactaactgaatgctctcgcaaatgtaggtcaaatgcgagtgagctgtcaacgcagatttatggtcatcctacgcacgtggagttttctttaatttaccatgtggatgagcactaacactaggaggtctagcagtgaggacaactaaatattgattcgtcgccactcgttcaaggtgaatatgctggggtaataatagttccttccgaattgcacgtggtatcatactaggtggtaataactccatgagctca

SEQ ID NO: 7976 - DNA, 397 bp, Diabrotica virgifera
  unsure (1)..(397): unsure at all n locations
  Clone ID: LIB3026-027-Q1-E1-A12
agcccacgcgtccgattattacaaagccaaaaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatcatctactgcacctacagattcttcatctgacccagcaactgattcatcatctactgcacctacagattctacacctgacccagcanctgattcatcatctactgcacctac

SEQ ID NO: 7977 - DNA, 241 bp, Diabrotica virgifera
  Clone ID: LIB3026-027-Q1-E1-A4
attttaaaataatagaatattttttagtaaaagtaaagaaaaattttgattaatgatagtcaattagtattgtgagagaatattttatttttagaaaagaaaaatttattttttgtaccttgtgtatcagggattattaattaataattagagatttagtattttcgaatttagaagagctaaaaatttgaaatttttattgtaaaataaatattttaaataatttttttggaatgaaatg

SEQ ID NO: 7978 - DNA, 431 bp, Diabrotica virgifera
  Clone ID: LIB3026-027-Q1-E1-A5
gggccacccacgcgtccggttatattaaatatatttataataatttatcctatcgtcatcatgagaagtttaatagttgccacgattgtacttttcgccgtttatcaggcagtagatggtctcattgcctgtcacgaaaccttttgcgacaatcaaaaatgtacagaaaacctcgtttgcaaagattctgaagttctggttccaaagggaaccatttgcggatgttgcgacgactgctacagaaaactaaatgaaggcgatgcttgcaggtcacgttttattggaggaggtccattcagaggaaaatgtgtacatggattagtatgtaacgctgaaggaaaatgcgccaaagcctaaattatcaacaggaactattagggtgataaataaatgatttcaatggataggtggaaaaaaaaaaaggcgggcgc

SEQ ID NO: 7979 - DNA, 110 bp, Diabrotica virgifera
  Clone ID: LIB3026-027-Q1-E1-B3
gagggccaccaactttgcaaattttgaaatttttaggtgcaaacaagttatgtcggaaattttagattgtaaatagataatcatcaatagacaactggaactccgttaaa

SEQ ID NO: 7980 - DNA, 130 bp, Diabrotica virgifera
  Clone ID: LIB3026-027-Q1-E1-B6
cacacgcgtccggccgcccttttttttttttttttttttagtttccaaaaaatgaatatttttattgggtatgtatgacactttagaaacaataatcaaaaatcacttcatatcaaaaacaaacgttatt

SEQ ID NO: 7981 - DNA, 367 bp, Diabrotica virgifera
  Clone ID: LIB3026-027-Q1-E1-C12
aggagaaaacatcaccgcctctactaatgttaccgccaatgttgttggcaaggtaaatcccttcctttttggcaaactcacaggtaaggctatccatgtacatgtaccaattgtaacctttgttgactagacagttcatttgggcaatcccgccatctacgaggaggtttatagccaaggttaatgaacccgcataaagtcactcataaaggaatctagggatatgatgcagattatttggtcacaagcgacttcgatggaaaggcacacaccgcagtcttagatgcaaagtcaggtaccaaactaaacgatgcgacctccatgctgaactcaaggtaagatctggagtaccgtcaatccaacaaag

SEQ ID NO: 7982 - DNA, 386 bp, Diabrotica virgifera
  Clone ID: LIB3026-027-Q1-E1-C5
caaacgcgtccgaaacatttcacaaatatttacctattaagacttaattgatatatatatatatattatatagaaggaaatacaagtaaagtatatatcgtaaaaatagacaaaaaatctgcactagtgttgtaattattactaatgtttgctcagctcatccataacttaaaccaagtcttatagagtattatacggttgtaatagttaggcagattatgtatttatttcgacgcttagatacctacctcagatacttatctccaaaaacgttcagtataagaagatactaggcatacggttagtaccttaggactcacccggaggaggagcgagcttctcgtggggagctgagcagaaatttacggtacttgagacctaaaagt

SEQ ID NO: 7983 - DNA, 259 bp, Diabrotica virgifera
  Clone ID: LIB3026-027-Q1-E1-C7
aacgtatattaagaaaatttaccattttctctctgaaacccagatttttatgatggtaaacatggtgaaacctctctgatgaaaatctgatgaatgttgtgtacatttgccgtactttggtaatgaaatctaatacttttatttagcttacataacatgacgttttttttagatcttagtcaagttcgtttgtaagttgcttgttttttagtcgaatggatatgtacttgttaagttgtattaatgatgtagatttttt

SEQ ID NO: 7984 - DNA, 294 bp, Diabrotica virgifera
  Clone ID: LIB3026-027-Q1-E1-D10
aagtaagattttatcaatatttaatttttaaatgaaacttacgattatctgtttacatattttagtatatgtaattatttatttttatatagcattatttttattttttagggagttttttagaaatgtataaatttaatttaggcaaatttactaatgatgataatattactattaaatctttatatatttactagaaatctttacgtttaatacatgaattctgaaacattattttcaaatgtttagtaatatcttgtctttttgtattacatacattctcactcctgaaaa

SEQ ID NO: 7985 - DNA, 398 bp, Diabrotica virgifera
  Clone ID: LIB3026-027-Q1-E1-D11
agcccacgcgtccgaaggagtcgtacgcaatatatcaattcagagacaaatgagacacacgttctagaaggagaagcacaacaaggttcaacaactggggaaggtcgatttctagtacatttcttaaatccagacgtaactgtacctttctatgttcttggtacagactatgaaaattattctgtaggtttcgtctgttttgaacgtaatggtgtttttctagagagtcttttcccttacaacaagaactccagttccaacacgagatgagatagatgcgattaaccaagttcttgacgacaacaatattgatcgtgaccaaataatcgatacagaccaagatgattgtacttattagaacgttattagattaaaataaaatacgagtatattatctg

SEQ ID NO: 7986 - DNA, 271 bp, Diabrotica virgifera
  Clone ID: LIB3026-027-Q1-E1-D5
aaatttaacagtagtaaacggtgcaagaatagaatggaaattcgttaaaaactatcagttcccacaactttttgacacagaagcttatcatgttgctagggtcggttgggaatatgaaggaatggaatttaattcgactacatatcttggaactgtcaattttaacgatcaaccaaatatacgaaaaatttttaatgctgcagttctttgggcagaaaaccacgttttatatttcccttcacagggaacacttttgagcggatactcatat

SEQ ID NO: 7987 - DNA, 99 bp, Diabrotica virgifera
  Clone ID: LIB3026-027-Q1-E1-D7
gcaggaatgaagggttggatgaaaaaaaaactgtctttatgtaagttaggaagaattttagtttgaagtgaaaaagcttaaatttttttaagagacgag

SEQ ID NO: 7988 - DNA, 293 bp, Diabrotica virgifera
  Clone ID: LIB3026-027-Q1-E1-D8
taaaaatcatttagttttggacatttgtatgtataatgaccctgctatgttggattgcatgtacgttgaagcaatgaatacaatgcaaacaaacccagattatgcaaaaatgttcagaggtagaccgggaagatttgtgttgcctctgaactccaattcaaatacagataaaaccaaaaatttagttgggataaaaaatacaagagccaaagcgtattatatgtccgatggaaatatatttgttaagccagaaaaactttgcgatttacgctgtgagactcccagaatacatt

SEQ ID NO: 7989 - DNA, 195 bp, Diabrotica virgifera
  Clone ID: LIB3026-027-Q1-E1-E10
gacccacgagtcagattcttctttatatttttcttatactccacttttaataacttgttacaaactattttatattttgatatttacttttgttacatacgtgcgttcccaacttcgggggggaatcttatactacttccacttacttgtacctacacctctttttcctctttatttctacatatttatcttctc

SEQ ID NO: 7990 - DNA, 274 bp, Diabrotica virgifera
  Clone ID: LIB3026-027-Q1-E1-E2
ggggccagccacgcttcgggaaaaattcacttttaatttcacttgaaaataacgatgattgtaaaaactatattttatatgttatttcttatataaatcaggaatgtgtaaggaaaaaatttatgttaaaaacggagactccttttgaatttacatcaattccaggaaacctaaaagttttttcaggtctcaacgatgtcaaagaactagttaatttagatcttttaataatctgggtggatagaaaatatagtctatctgcaaaagatatttg

SEQ ID NO: 7991 - DNA, 278 bp, Diabrotica virgifera
  Clone ID: LIB3026-027-Q1-E1-E7
gcagggcaaaatcaccaaactcaccatacccatagggatggtaatgttatttcggaaattttaaggagtacactagacgtcaataaatacgcaactaaaaagacaattgctcaaggacttttggacattgctctattgactgcaaatgcatctcaattgaggtttagcgtagaagttggagaagaacatcaattttatcttttaatgttgatattgatatgaaccagcataatattagaagttattcaagctgccctgtgtgtaattttgggaggatc

SEQ ID NO: 7992 - DNA, 405 bp, Diabrotica virgifera
  Clone ID: LIB3026-027-Q1-E1-F12
aggctataaggacggtacgaagaacgctcccttcacagccatataacaactacgaactgtgtcctcgtatttttcgcagcataatagagataataactatttattatttttatataaaatcgtattctatttttatagcaatgttgccagttttttcattagatattttaattttagacaacggctcaaaggactatatgtgttaacaatattttcatcaattttttgataacttttatacattttagattagaaacaagtggtgtaagcctttttctttcttctggttgtttaagtttaagatagacatgaagtctggacagtaaggaaactgattgtataaacttcaaaaatatacgtgtcaaatttttagcctcttgattcttcagttaaatcttcaattta

SEQ ID NO: 7993 - DNA, 102 bp, Diabrotica virgifera
  Clone ID: LIB3026-027-Q1-E1-F4
cggggccagcacgcgtccgaatttataagcttaggttttattcctcctattgttcttctttcaaatgttggataacatcataacttttggatttcgtcttag

SEQ ID NO: 7994 - DNA, 198 bp, Diabrotica virgifera
  Clone ID: LIB3026-027-Q1-E1-F5
caaacgcgtccggcccgtcttgagctcatctcacaacaattgattccccagatccgtaatgctctgttcggacgcaacgtcaacagaaaattcactgattaagtattttttggatactgtgtattgcctgtattttatatagtattgtaaaagattgttggttgcttagacagatcttcaaaaaccttttaaactact

SEQ ID NO: 7995 - DNA, 405 bp, Diabrotica virgifera
  Clone ID: LIB3026-027-Q1-E1-F6
cacacgcgtccgaaactcacgcatcaatccaagagtttgttattaataggttccaaacaattttaaaaaaacgtactacagatacaaatagtatatttttgattactcactctttcgaggggctgttttaatgtcggtatttttaagttttgtccttactcaatgtccatttagtaccccgtcattgtatgtaaattaattaaaaatgcgcaacagaaaatgtagaacttttttttattttaaaatgcatttaaaattcgtttaacgatgatataattgctttaatgtatcatgtaatactcccattgaacatataaatcgttattaagattatttcttgttgataatacagaagagaccatattattagaaactgcattcgaaaaattaaagaaatgatagata

SEQ ID NO: 7996 - DNA, 292 bp, Diabrotica virgifera
  Clone ID: LIB3026-027-Q1-E1-F9
agatttattttaatataatcatttatttttaattatgagtaaacttttattttacttaaattgaatgattaataattgtcagtgagtttaataattgtattctgcagaggtttatttttaggtttatgatcatcaggtattagtaatatatagttatatactcactagtattaagtttcaatttcaatggaccttttaaattttcattgtcaatgtaacattctgattatattttttattgtcatatggaattaacgtttggtttaatctagttttgactgcattaaattca

SEQ ID NO: 7997 - DNA, 268 bp, Diabrotica virgifera
  Clone ID: LIB3026-027-Q1-E1-G3
gttcggatttaaaggagctaaaaaattaaaattttaatggtaaaataaatattttaaataatttttttgtaaggaaatgttatgcgtttttaaatatatcgaagtttttaagaaataaattaaatttatttatgaacaatatatttataattaaatattttgagattagtaatatgaaatatttttagggatgagcttaaaaataaaattttattaggagttaatttttaaataaaaattaggattaaaaattttcagagttgaaaat

SEQ ID NO: 7998 - DNA, 388 bp, Diabrotica virgifera
  Clone ID: LIB3026-027-Q1-E1-H12
agaaaatggcggagatattgagcaaaaacggttctcgtttaaaatcaagatggcggctaacgcaatagcgcggttcggtcgagattttaaatttgcactactattgacccccctaaagattggaaaactaaaatttggggcagctcctaatgcaaggttaggcctgttattcgtctaacccgactgaactattattatacttaaggacgatactttcttctcaatttacttaagtttactttttctacgatctctagataacaaaaccgtctttagataacaaaaaaccgaagaaaattaatttcacagttttttgttttgttggcagaaaatacaaattatatgcaaggacgcctacaaaaaccacttaatattctgaatcagattg

SEQ ID NO: 7999 - DNA, 134 bp, Diabrotica virgifera
  Clone ID: LIB3026-027-Q1-E1-H7
ccaacgtcgttattgtgaaaatcgacgttgatgaatgcgatcatcgcgctacggaatagaacatcaagtccatgcccacagtcattttcctgaagaatggtcaataaatcgcgaatttcagcggggctaactac

SEQ ID NO: 8000 - DNA, 373 bp, Diabrotica virgifera
  Clone ID: LIB3026-027-Q1-E1-H8
cgcgggggcacccacgcgtccgcataaatcgaagatgtaatatatccaatgctttatagactgggtaatgtgaaaataaattttaaaaaatataatacaaatatatggatagtgtcttcagttattacgctcaaaatatttttaaggtatcattactttgatttagaaaattgtatcaagcaattggttatatgagtatcgaactctgttttaaatagactatattgttacgcttcatcgaaaaatcaatgtattgaactccaagagaagttacaatactttgaactcgtaacacagtgacaacttgaaacatcaaagttagaagtacaagtgagctagaaaggtcaacaccatagaggtttttatatatttt

SEQ ID NO: 8001 - DNA, 93 bp, Diabrotica virgifera
  Clone ID: LIB3026-028-Q1-E1-A10
agcggacgcgtgggagatattagaccatgacctttattaggagcttttagagcaatattaacaatattaggaataattaaatgatttcattta

SEQ ID NO: 8002 - DNA, 322 bp, Diabrotica virgifera
  Clone ID: LIB3026-028-Q1-E1-A12
aggtaactattacatgaaatacaaaagtagtaagtaagataaacattaatagcttttttacaaatcttttcgaaaattagatttgcacctgtagttgaaattaaacttgggacaggtctgacgctctataagatgcatacttatgtatccgtttatgacaattatttgtactttaatgtcgttacttaagcactcttaagtgtatttcctttaggtgatcatgtatagtataaatttttcgtactcaagcataattgatttgtgtcacatcccctttaagacgatttgactaaaattaacaatgcctatatctttctccctt

SEQ ID NO: 8003 - DNA, 392 bp, Diabrotica virgifera
  Clone ID: LIB3026-028-Q1-E1-A3
cacgcgtccaatataactccgaagactctgctgaagaagatgctgaagatgatgacgcttccaagaaagatgagttgtagagtgtaaaagtgcatttgttagtttaactataaagaactttacttagatttttttagatttgttttgtacagatttttgtgatttttttactattatcgttttttcagttttctcatgatttgttcacgatttagatttatttatattagcggaataggaaataattaactctccatttattggagaatgtatgagactggttgtgttccgtgctgtcattgttgacagttgtaaatcctccgaacatttttttataaagttgataatatattttgtggaattatgtctacataagaggaaatgcggctacc

SEQ ID NO: 8004 - DNA, 414 bp, Diabrotica virgifera
  Clone ID: LIB3026-028-Q1-E1-A6
tgtttttgaaaagttttgggcacggctcaagtattttattgtttaaatttaagatgaagtacgaatgggcgcgcccgaatccgacaagatattgtatagccccgtattcgttgtcaaaccaacgggtcttgctctggtagttaatttcggcgttagagttcaagaaggaagtagatttttttatacttatagtaaatatattatgggatatttaaagactggccgattggcttaccagacttacgtcccgcagatcttaaccggcgatgagtattcgaggtttgtttctggtcagattcgggcacgtcgtactgtacataaaatacttttgtttacttctcaaatttgtaactcagttgtggatactttgaggcgtaattttattttgacaaactgtggatttaaggttacatt

SEQ ID NO: 8005 - DNA, 412 bp, Diabrotica virgifera
  Clone ID: LIB3026-028-Q1-E1-B5
aacttcagaaaaaaaacgttaacgaaatttgatgacagcttatctttttatgtcccataaacacactgtattttttttatttaaaatatttctttctcctcttttaggctattgattatgtagtttagaaaggaactacaacgttaacggggttttattgtttcatatactcaatggacgtctaaatatgaaaaaacccgcggagtgctaccatttaaagctgtgcgtttttgagaagggggtgcattagtcccagggctcccgctaccatatgtgccaagtgtgcaatgcacacgggcgccttcctttaggggcgccaaaacccagggtaaaaaattgcaagaaatttgaaaaaaaaaacaaacataaaaaacaaaaattaattttaaaataaaagttgagaaattaaata

SEQ ID NO: 8006 - DNA, 363 bp, Diabrotica virgifera
  Clone ID: LIB3026-028-Q1-E1-B6
aaatttagaaacatgaagactacctttgttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgccaagttttaccaggagatttgaaaaaattgtgcgaggacaagttaattccagcaatcgaccaaatgtacaaccaggtggaagacactcctcctagagatttatgcgtagagttggaattctgtaattaatttgtttgttagaatattataataaaaactcaaaattaaaaaaaacaaaaa

SEQ ID NO: 8007 - DNA, 266 bp, Diabrotica virgifera
  Clone ID: LIB3026-028-Q1-E1-B7
acccacgcgtccgacaataataacatattttttagtaaaagtaaacaaaaattttatttcctgatacttaattagtattgtgagagaaccctttatttttatcaccgactggcttcattttttgtaccttgtgtatcagggattattaattcatccttatatctctattattttcgaattgaaaccagctattcaattcaaatttttatcgtcacatacatattttaaatcacttctctgtaccgagatgtcatccgtctccatct

SEQ ID NO: 8008 - DNA, 400 bp, Diabrotica virgifera
  Clone ID: LIB3026-028-Q1-E1-B8
acccacgcgtccggatatttttgaaaaaactatcattgaaaatggtttttaaagtatcccttttgtgtacactgatggtgttagttgcttattctagtgcatacgattacagcaattgtcctggaaataccaacagacaaaaaaatctgatatacagctctttactcccatcagcgtatagcgcgaaaactcgtatcccagcaactggatattaccaaagacctatcacctgcttactgctaatcgatcaaaaaggaagcaccagctcaccaaaaattatagaaggtggatatctcgacacttttgctgtagtaaatatcacttccacaactgcgcaaccagttagttactatgcaatagtatttattgattaccctattttagtagtatttagctatat

SEQ ID NO: 8009 - DNA, 227 bp, Diabrotica virgifera
  Clone ID: LIB3026-028-Q1-E1-C2
acggagcgtgggcggacgcgtgggaaaaaaattaaacaacacaaagagaaacaaaaaataaaatacaaaaaaagaaattatacaaggggattgcaaagtccactcaaagtcactagtggcaattgccctgggcagcccctcaagaggctccactccttacatttccctctattcgcctatcaaacattttttacgcaggctcctagctccacaactgggtgcttcca

SEQ ID NO: 8010 - DNA, 87 bp, Diabrotica virgifera
  Clone ID: LIB3026-028-Q1-E1-C5
acccacgcatccacccacgcgtccgacatttatttcgataataaatttatttaactgcgcgcgctccgccatacctctcggtttttt

SEQ ID NO: 8011 - DNA, 180 bp, Diabrotica virgifera
  Clone ID: LIB3026-028-Q1-E1-C6
acccacgcgtccgaaaaaagtaataaaaaaaaagtaataaaaaaaaagtaataaaaaaaaagtaataaaaaaaaagtaataaaaaaaagtaataaaaaaaaagtaataaaaaaaaagtaataaaaaaaataataaaaaaaaagggcggaagcacaaaaggataaaagcaaacaataagca

SEQ ID NO: 8012 - DNA, 421 bp, Diabrotica virgifera
  Clone ID: LIB3026-028-Q1-E1-C7
acccacgcgtccgcgatatggtttgtatatacagttatattgaatttaactaaaaattactcagaattcaagtattatgtagtacattgccgaacttgaagagttatggcgaaatattgtactacactacattacttatagagagttaaagtagggtaaatatgtaaactgtcttggactctatgagtctcaaaattttgaaattacgtatatctttattaaatgtgagtaaatcttaaattacgtgaaactgttatcagttctatctatcagaaattctatcaaagattcggcgaaaagcgttgtacctattatctgcgtagctactttaagtagatacttacgattaagcaatacgtagttattagaatacatgtttacatttatattttttatctaactttaactctctaatccacag

SEQ ID NO: 8013 - DNA, 385 bp, Diabrotica virgifera
  Clone ID: LIB3026-028-Q1-E1-D10
agggaaggtttaaaatacctttttatcgcatattcctcgtaaaagtgaaatctggcagtacagtgttgcgaaattgagggctttttctggaaaataagattatgctctttttgatttttgtgaacggtgattgtggaagagcaaacatctcgactggttctttgggtataagcgacggtgtttcctcgtcggcaatcgctgggttctaattaacatatatgtcaatagaaagtttttaggcacaaaccgtcaatacatataggcatgctattgtcgaagatgtctaaagatccctagaactgtagaattgtttcatttttcttttatttcttagtaggtaagtttgtgatttatattgatgtgtatgccaattaatataactaat

SEQ ID NO: 8014 - DNA, 101 bp, Diabrotica virgifera
  Clone ID: LIB3026-028-Q1-E1-D2
tttttcgagcttatttttttactattttatttgccaaaatgttgtttaaataatttttttgttaagatatgttcttcatttttagatatatcttgtttttt

SEQ ID NO: 8015 - DNA, 144 bp, Diabrotica virgifera
  Clone ID: LIB3026-028-Q1-E1-D5
atttacgtgtaagttttgttgattgtgacgtgattccaatcaaattgcggttaggactaggtgtacgaccaattatacctcctctcttagaccttgagtcatacccgggcggaggagatgatcttcccgaccgtcagtttgggc

SEQ ID NO: 8016 - DNA, 309 bp, Diabrotica virgifera
  Clone ID: LIB3026-028-Q1-E1-D6
aaccacgcgtccgcccactcgtccgctaatatgtaatttatgactttagttcaggaaaaacgtatatcgcagtatttccattagttcgttatagttattgattgtcatcgggtttgcgatttttgacatttttatgtgtcatgggcgttatgtccgatatttgagattgtcaatagatatccatcagtttttgccatggaactccgttatgagctaggagactcgtccagagtttagggaggcagtttccggatctgtgtgccagtactggtgtacatccattatgcccagggaagggtttctggtctg

SEQ ID NO: 8017 - DNA, 402 bp, Diabrotica virgifera
  Clone ID: LIB3026-028-Q1-E1-D7
agaagaacaggtctattaatgctttgctggaggtcggtactgggaagctgttggggaccagtaactgggatgttaatgtggtagcgggaattttatctaaggatggatcagtggaattttctgtggactattttaaggtccacataaacatcagccagaacatggacacttcgatcccaccatcgttagaagacattcagttagaactcggcaacatacaaattacattcgatgggttaggtactgtggattatctcatcgaattcggggtcaatgttattccgaacctcttaaggtatcaaataatggatgccgtggagaaactcatacagtttaaaatccaggaagccttaaatcaaatcacgatcgacaagttgataaaccagaatgcccaacaactgg

SEQ ID NO: 8018 - DNA, 335 bp, Diabrotica virgifera
  Clone ID: LIB3026-028-Q1-E1-E10
agcaaaaaatcaaataattgattacatacttcaggaggaataccatctagctgcaaattatataaattttgatttgaatgacattggagtagcatgtggcttggatatttacaattatcttactctagtgtcagatgacagagcgcaagaatatatggaacagttatttcaaagagaagacttacgaaaagctattcacgtgggtaatactgaatttgatgacaaaaacgtttactcgaatttgtccaatgatatcccagtctctcaagcccatttagtagctgaccttcttagcaaatacaaagtcttaatatataacggacagctagatatta

SEQ ID NO: 8019 - DNA, 403 bp, Diabrotica virgifera
  Clone ID: LIB3026-028-Q1-E1-E11
aggataaaactaaccaggttatttcatatcctgcgctagacaaattgccagagggattcaaaataattcgtcctccaagaacattaaaaagagcatttatagataggtccaacttagtttgccaagatagtggcttccactgcaaggaaccgttcgacaaatctgcaacatttcaatttgaatgtgaaatcgatgatcaatgtccccaaaattataagtgctgtccgcagaaatgttttaaacataaaatatgttcacaaggaaacattcacagttatggaattggcaacggcccttctgtgaatccttttattcatagaagatccagccaacctgacaatgattcgtctaagaaccagaagacacctagacactgtcaaaaatggccatatccttgctcacg

SEQ ID NO: 8020 - DNA, 398 bp, Diabrotica virgifera
  Clone ID: LIB3026-028-Q1-E1-E12
agataggattctatggttaagttataggtcattaaaatgtattatcaaacatttagatacattttagtaataaatttggttgtgctataaagggggttgccaaagttgaacgcaaaagtttgtattattgccaataacttgtagcaaccccacttataactctttgataatacatatttttgttgtttgctcgtaagagatttttgcgaaattttgtaattgacatttgacataggttcattccaacttacaattaaacggcaatttgggtggttgcgcctcaattcgatatatttttactacacagaatgttttatgaactgtttgtccacttaacataatgatcttgtaaaaattcattttgtaacagtgctgtatgatttttgagtgcatataaa

SEQ ID NO: 8021 - DNA, 423 bp, Diabrotica virgifera
  Clone ID: LIB3026-028-Q1-E1-E3
aacgttgttgacgcttcagcagctgcaatttattgatccgataccgggaatcgtttttacgttgaattgtttgcatgcttttgatgattcttgtttgatacatttgataattttattgggaatattagtgagtttattttgtagttttttatcacattctacattttaaatgatattctattttttaaatgataccaaaatactgtgatgatatatttgcttagttatcgtgaattattatcgtctgttttttattcaaattttacaacaaaaatctattattacttatccttatctactaaattaacagtaacattgattccagacattattcttaagaaatatcatattttaccaattttttggtattaacttcgtaaatacgtcgtaatagtagttaggacacttaagatgtattttttt

SEQ ID NO: 8022 - DNA, 399 bp, Diabrotica virgifera
  Clone ID: LIB3026-028-Q1-E1-E4
aaagcgatcccgcgcatgtgacagacaaagatggctagaccactcaagcctaaacacggtgtagttgaggttctcaaaacgttcaatgtcaaaactgtaatttatatgattgcagaatcttgggaacaagtgactacaatcagcttgataatgttagaaaaaaactatggaagcatgtatgtgacttgccagaaaattcaattcaaccagtggagaactgttacctggaaaatgactcgccagactaggtccagccccaagaacttttggatatgttccaaaatattgacggttgctctgaagtcgatgaaagtaacattaatctgtggttagaggcagataacggagattatgcgccacttactgacgaggcagtgatcgcattgtgtttacctgatg

SEQ ID NO: 8023 - DNA, 214 bp, Diabrotica virgifera
  Clone ID: LIB3026-028-Q1-E1-E7
atccgactccatgtcagattattaatatttcattatttagattaccatcccccgctaatatttcttcattatgaagttctggatcagtataaggaccatgtttatgaattcagcgtatgcgatgcctatctttagctctccgtgattgcgaagattgtttaccagcatttaatagagttgctcatctttgccgagatctatcttatggtctgat

SEQ ID NO: 8024 - DNA, 190 bp, Diabrotica virgifera
  Clone ID: LIB3026-028-Q1-E1-F10
tcttgtttaagacctacttcatttcgtaattttccaatataacttgctaaacttccattatcagggggcctaattctagaatcgataacaaacccacgatctagccttcactcaatttgccgattggtctaatgattaatttaaagctttgttcaattctcagtttatcttcataccaaaactatccttt

SEQ ID NO: 8025 - DNA, 379 bp, Diabrotica virgifera
  Clone ID: LIB3026-028-Q1-E1-F3
cacgcgtccgaaaaaaaaaaaaaaaaaaaaaaaaaaaaaataaagaaagaaaaactaaaaggataaaacaaaaaataaacaagaaaaaaaaaaaggggggccgcccaaaaggttctcagcctttcgtatcactgaatcgttatttatcaacccttccaacttgaaccctactgttcgatttcagggggggggctctttccagggcaatgactgttacaccctttgggttaaccaccataagccccttgcaaattttcccccttttcagttagggcgccttttttgaaaaggcccatgctgattacctttccgcactattcgcctacccaattgtggaaacgcaccccctcttcgcctgggctttaacctccgcggggcc

SEQ ID NO: 8026 - DNA, 316 bp, Diabrotica virgifera
  Clone ID: LIB3026-028-Q1-E1-G11
agttttatatttattaaagattatttaagattgtgtaccttgtgtttcatggaatatagtattgacgataataatataataattacgatgtaaattgagcaaaaatatgaaggtttataatgtgaattcggcaacatttattacacctgtgtattaaaaagatatccgtttgtaaaaaaaacaaagtctcgcctgcccactgattaattagataggacgcggtaatttgaccgtgaaaaggtatcaaacacaaaaatttttttattcaaagcaggagctaaaggttggatgattaataaactgtcattatttaatt

SEQ ID NO: 8027 - DNA, 347 bp, Diabrotica virgifera
  Clone ID: LIB3026-028-Q1-E1-G3
acaaaaagtgaatggtgatgctggtatgtctgctgtttgatacaaaaaccaaactcgtatcacgagttgcctttttgtaccatccggtagcgctataatatcgatttggcttttggtcaaatcgaatcttatggtgctgtttttggtcgagctgcgaaattcttgtgtaaagactctaaattgttcgccgtattaatgaggattttctagttttatcaaaaacggttccatgttgtaaatatcgtgcaatataagtgtatgttatatattttatatatttttgtatatttttttatgaatacggtgacaaataaatgtatttttagtataaaataaaaaagataaaa

SEQ ID NO: 8028 - DNA, 409 bp, Diabrotica virgifera
  Clone ID: LIB3026-028-Q1-E1-G4
aaaaacatatttgacttattttatatatttcaatgagtgatagattattttaaatatttatattttttatatttagttagatctgtaagtgattcattatccccggtcatttaataatgtaacttgctaccaaaaagtgttataactttacattgttcaagattgggttattctggagtataattaaatactttgtgatggataaccgagtagcttcatgtcttaaaatatcgattttataaaaaaaaacatttttcttatttggataattattcaattatcgttgacttcaatttaaagttttaatactttttggtagcactttcaatagtttttcatattcatcatttaaatattttaagagttcatgatttcacgttttaagtgaatgtttgtcatcaacatgttt

SEQ ID NO: 8029 - DNA, 417 bp, Diabrotica virgifera
  Clone ID: LIB3026-028-Q1-E1-G7
acccacgcgtccggaacagtcttccccgtatacatccggcgttgaatagcaactggtttaacaccttccgctgtcagaaacctgataacgccccgctgctcctcaatcgtcgaattttgcaatgtgaacgccatgatgtgctcacacgaactgtcgcgtcaattggacggctctcttataagagcctctattctctcctgcgcatgcgggcgcccgggaatgccccgatcgaatccgaaggctacatttgcctccctggatgtctcactacgttatcccataacggcataggcaattatgtttgcggttaagttgttacgacgtttcgtgccttttcatttgatcagtcgcagtataatatacaagagaagagggaaaacaaattttgatttgttttgcctcgtacgttacaatacc

SEQ ID NO: 8030 - DNA, 201 bp, Diabrotica virgifera
  Clone ID: LIB3026-028-Q1-E1-H12
aaacggttcgcaactttaaacgtataatggaggctagagtaattgcgcggttcggtcgagattttacatttgcactacaaatgaaggagcaaaagttttgttaacacaaattataagtatataagaaacttagatagcaggggtattcgtctaacccgactgaactattattatacttaacgacaatacttacttctcaaa

SEQ ID NO: 8031 - DNA, 363 bp, Diabrotica virgifera
  Clone ID: LIB3026-028-Q1-E1-H9
ggtcagatatccgggtcgaccacgcgtcaggaaatcccagtctaacattgtgcccgttcagtcagatatacgcatatccatcagatcagatttgtttgttacagtatccttcatgatcatgagctcccattactaatctggggtttttctcagatgtgttttgaatatgctttattactgcatcactcacgaactttttcctgaaatttgggagcccattagattacatatgattacgagatttaaacgtcccttgaacgtgttacttaaaatcatgtactggatctagtcacctagcagatttagtaaaatgcatcatcgaagtcgaaaccagatatgtacttacagttatagctgaatgca

SEQ ID NO: 8032 - DNA, 391 bp, Diabrotica virgifera
  Clone ID: LIB3026-029-Q1-E1-A6
atgatattctttgcaaatcatctaagccaactgcaaaaccaactgcatcgtcggcatacataatgttgtttagacgcactcgattgactactccttcctgtagttcttccagtgcttgctggaagatatgttcacagtacatattaaataccaccggggacagaatgcatccttgtctcactcgtataaccactttatgcatctgctattaagcacatctataatagttgattgtaatacattcgttttggtcatttaactcctcttgtatgaatgaattcacagcatgtcctcacacaaaagacaaaaattgccaaagaacacaaattcaaacacaaaatagctaaaaagtacaaattataaagaattcgttaagctttcactgggaatg

SEQ ID NO: 8033 - DNA, 427 bp, Diabrotica virgifera
  Clone ID: LIB3026-029-Q1-E1-A8
cccacgcgtccgcaaatagaatgatgggaagcgcagattaaagattagaaaccaccattgtacagtgtactatgagagttgggataaattgagggtagttaagaagaacaaacaattgaccattagcgatgagttggctgattataatctaccaacactaaaaaggactaaattagatgcgcagaaatctgaaggacctgttgagctgttccctagcgactctgaagaagattacgatgatgaatgtggtaaacgaaagcgaggtaaaagaggaggaaagaagattaaataggcagctccatctggtcctgtcgagccggatgatgatggagaataggatatagtggaagatattgaagtacacgattggtgattgatttaactgcataaattttggaattgttgaaatgattaaaggtaatccttt

SEQ ID NO: 8034 - DNA, 135 bp, Diabrotica virgifera
  Clone ID: LIB3026-029-Q1-E1-A9
agactagttctagatcgcgagcggccccctttttttctattctttctttttactttttatctttttgctatttttttttttttcttttcttcattttttaactttgagagtggatttattttgaaaaagacaaaa

SEQ ID NO: 8035 - DNA, 371 bp, Diabrotica virgifera
  Clone ID: LIB3026-029-Q1-E1-B1
tcgacgacgcgtccatgctctattaaataatatgtaactatttgctctatattttgtttatttatttttccattttaattttatgcagtaagaattaccctaggtactgtaaaaacatggtctgcacatatttagtaaaattcgggagattttttataaaaaaaactaatttattttattgaagagaccttatataatcttgttaatactcaattttagacttgttaaattgtttaaagatagacaatcagaatcagaaatattcaagagtgtaaatagtgtacagaaaagatctacagcaccaaaaggggtattatcatatccttaaaatataaataaagaaaataatttatataaaaaaataagacact

SEQ ID NO: 8036 - DNA, 416 bp, Diabrotica virgifera
  Clone ID: LIB3026-029-Q1-E1-B10
agtagaaatttttgaaaaaactctcattaaaaatggtttttaaagtatcccttttgtgtacactgctggtgttagttgcttattctagtgcatacgattacagcaattgtcctggaaataccaacagacaaaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctattgattagcctttagtagtatttagatatatttatgcactactatta

SEQ ID NO: 8037 - DNA, 136 bp, Diabrotica virgifera
  Clone ID: LIB3026-029-Q1-E1-B11
ccttcaggctaattgtagcacttccccgtatttgcctaatttccacctattcggtttgtggttatctaacattaggaaaaaacactggaattgtaattttgtggcttctgaaggcggggctacaggtgaaacattc

SEQ ID NO: 8038 - DNA, 348 bp, Diabrotica virgifera
  Clone ID: LIB3026-029-Q1-E1-B12
cttccattgttttagctattttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaac

SEQ ID NO: 8039 - DNA, 324 bp, Diabrotica virgifera
  Clone ID: LIB3026-029-Q1-E1-B3
aattaaatataatacaataatttaaaaatcaatacattgtatttcagcgtatttgaaatgtggttggtaaaggcagtgcctaggaatgttggtggtagtacacactcctgtttgacctctggtgtccaatttcgtgttgttcgaaaagccatttcaatttgacagcacttcccaggtgattaataataatgcaagtacaatacatcttacgccatcagttctttgaggaatggttcgtacgggatgaagccatcatcatcttctttgtccatacaatcggctaagacttgttccgtttctgcgtcagcgtacactctcaccacg

SEQ ID NO: 8040 - DNA, 105 bp, Diabrotica virgifera
  Clone ID: LIB3026-029-Q1-E1-C12
acgtccatctcagatttagtctgttctactttcaaatttttacatcatgtgacgttaaaccggtgtgagccaagttagttcctaccttgaaacaagaattaaatt

SEQ ID NO: 8041 - DNA, 348 bp, Diabrotica virgifera
  Clone ID: LIB3026-029-Q1-E1-C6
aaaaaacaagaactaaagatttaagttcgacttttccatacgcttcgatagatatgtcacatgtactatttttgcaactatcatatggcacttccggtcagaactttttaggtggaaacgatattaaaaccaaaattaggtatacatatttgttctcatcttgctaaggcttaactgaaactaaggcaatactttgaatttcattcgacacctcgaggagttgtgtttacggacgggcggacaaactgacgtggataattcaacgttttcacatttttccaaaattgggtgaaaacaaaaattcgtatattaccttctgatgatcaattatttttattgtgaccctag

SEQ ID NO: 8042 - DNA, 377 bp, Diabrotica virgifera
  Clone ID: LIB3026-029-Q1-E1-C7
acccacgcgtccgcggacgcgtgggcaaaaaatcttaaatgatacattattacaaaggtctgataattttataacatcgaagctaaaattatttcaaaggtacaataggttagaattatttcgacgctgtattcaaaaaactacaaaaatattaaatggtacctacatattacaaaggtttgacaaatttataacatcgaagatatagattatttcaaaggttcaatttcgacgctacatttccaaaaaactacaaaaaatcttaaatgatacattattacaaaggtttgataattttataacatcgaagctaaaattatttcaaaggaacaatcaggtagaattatttcttattttttaacccgaaggtatggatt

SEQ ID NO: 8043 - DNA, 68 bp, Diabrotica virgifera
  Clone ID: LIB3026-029-Q1-E1-C9
cgcgtcaacccaagcgtccgcccacgcgtccgcacacgcgtcagcccacgcgtccgctcacgcctccg

SEQ ID NO: 8044 - DNA, 71 bp, Diabrotica virgifera
  Clone ID: LIB3026-029-Q1-E1-D1
acgacgcgtcgagttaaatattaatatagaaacaacctggctcaaagcggtttaaacacatatcatattaa

SEQ ID NO: 8045 - DNA, 281 bp, Diabrotica virgifera
  Clone ID: LIB3026-029-Q1-E1-D3
gtccgcccacacgtccgaaaaacactttataccggtgtttcgtttaatttgaatcgcagctgcggtagttttttgaacaaattcggggacaaatttagttttctaaaatggcacatacatataaacttatatattttgatgtccccggaaagggtgaagcacttagaatgatcttaatctctggagaaattccatttgaggacatacccatccatatgggggattggccaattcttttgccaatgccccctcctggaaaactttccttgttacaggtcgat

SEQ ID NO: 8046 - DNA, 383 bp, Diabrotica virgifera
  Clone ID: LIB3026-029-Q1-E1-D4
acgacgcgtccagtgaatatggacaggtaggaacacccgagcatgcgattttcgactgtgacatttacgaagatgtcggtgatttaagacagcgattacaagcaagacaaatagcagaaattttaggggatgaagaactttataataatctagacgacttgacagacagagtttccaaaaaacaactggagctctacaatcacagaagaaacatacaacgaattccctaaagcttttgttatagaaatctttatcaattgagaattgtttttatacgttcaaatttagatttcagaatttaaactttaactttacacttgaccacgtacgtggatagtaagatagctcaaactacgtaaattagaccctcactgttaagcgaa

SEQ ID NO: 8047 - DNA, 316 bp, Diabrotica virgifera
  Clone ID: LIB3026-029-Q1-E1-D7
aaaattttatatgatgaaccaacctgtattctatattgtctaatattttgttcagttttggatgttaacatgtgtgatatgatgttgcacttttttgtaaatgttttgcagttttcttttaagtgcattttttgtattgtaagcttacgagtttattaatcagttccacgttgaactcttctttgtactatattaaaattagttttaattattattattattgtatagatatagtttttattgaggcaactaccaaattgaatgtatttcactttccaaaaatatatagccgtttaatttaaaaaaaacaccacgc

SEQ ID NO: 8048 - DNA, 411 bp, Diabrotica virgifera
  Clone ID: LIB3026-029-Q1-E1-E10
acgcgtcagcccaagcgtccggccgtatctctgactgacttctgtgattctgttcattaactcttggagggcttcagaactgtcagcgaataccactgtgtcgtctgcgtatcggatgttattaaactatttatatggaaatagcatccacatcactttaatgtaaaccttttctgcacaaccaatttgttaatttaaagttaaatgaatcgtccagttttataaccagactcaggagctgacttagaagaccgcaattgaatacttatttttttaaaactgatcagcataacagtgttaagatttttttatacaaataattgttacttcaattcagctcctgatttggtaaataacctgagacagcctatcaactagtttaacttgaaatgctgtttgacctttatgttc

SEQ ID NO: 8049 - DNA, 341 bp, Diabrotica virgifera
  Clone ID: LIB3026-029-Q1-E1-E11
acccttcagcttaaaaataaaattttattaccatttaatttttaactaacaattaggattaacaattttcatattttaaaatatgttactatttacttctatatattacgacttttacgggttacaacttttttatcaaaatataaactttaaattatttaaatttagtacatgacgataatattagtattaaaaacttgtatatttagtccaaacatataggtttactacccgaattcggcaacaattttttcacctgtgtattaaaaacacgtccttttgttgtaactacaaagtcccgcccgcccactgattcatttgaatggcccccgtattttgac

SEQ ID NO: 8050 - DNA, 431 bp, Diabrotica virgifera
  Clone ID: LIB3026-029-Q1-E1-E12
gggtcggccacgcgtccgcccaagcgtccgcacaaaaatgaagattgttttattagttttgttcgctgcttgtttgtcacaagccaaaataaatcaagatatacatttcgattgggtgcagtataccggagaaataccagagaatgctataataggcggatcaactgctgatggtgatccaacgtatgtagcccgttccttcctcagtgcagatgaagatgatgaaaattattctggaagtgactacaatggttatgtagctggtggtgtgttacctggaaaattgtcgatcgacctttgtactccgcagagtatatacacgctcacaaagaacattgagatactgactgtggtcaatggaacaaaaatcgaatggattaaatcttaccagcacacattcatggacctcttcaactcagacgactatcgtc

SEQ ID NO: 8051 - DNA, 395 bp, Diabrotica virgifera
  Clone ID: LIB3026-029-Q1-E1-E2
cgtcgacaagaccaccgatacccataacgatggaccaaagtgcaatgatagccggtttcttgatgatcggcaacaccgtggggacacccttttgccggaaaacattcctaggaacaaaatttagtattctaataggtattctaattatgggagctggatggactctgatgtggcaatcccaaaacatcttttggctactaggaagtcggcttctggtcggaataggcaatggatactgtgcaggccaagtcaagatgtacatcagcaatatttgcgacgaagatctgaaacagatgttcaccaaactaattaatttgtacatttttctaggaattatattgatatactcattcggaccttttattgacttcagatacacgtcaataacatgtatg

SEQ ID NO: 8052 - DNA, 230 bp, Diabrotica virgifera
  Clone ID: LIB3026-029-Q1-E1-E3
acgcgtccgaccacaagtccgcatgaagatcgctatccttgtttcagcccttgtggctcgtgcagtaactatccctttagaactaagtccagaaattaaattcattgagaaaggcattagtggagagggaattcctacccgttattgggattgtggcacaccttcctgctcatggaggggaaacgtccatatccctagcggagtaccaattgcgccacgcgacagatctg

SEQ ID NO: 8053 - DNA, 85 bp, Diabrotica virgifera
  Clone ID: LIB3026-029-Q1-E1-E4
gtccaaaatttatttatactacacatttaattacttggggtgattaataaacaaatttaactgttttattacacttttactatca

SEQ ID NO: 8054 - DNA, 103 bp, Diabrotica virgifera
  Clone ID: LIB3026-029-Q1-E1-E5
atccacacgtccgcacaaatatgaagattgttttaagagttttgttcgctgcttgtttgtcacagaccgttatcctatctagatgacatttcgattgggtgca

SEQ ID NO: 8055 - DNA, 177 bp, Diabrotica virgifera
  Clone ID: LIB3026-029-Q1-E1-E9
cgtcggttggatcagcgccgatctgtcggtatcttagtttacgatgacacttacttttcagttaaaaagcttacttttttttaaaagtacagaacaccctggggagttttatacaattattaatcaatttttttactaacaactttattgatagaccacagttagttacgtggggtg

SEQ ID NO: 8056 - DNA, 51 bp, Diabrotica virgifera
  Clone ID: LIB3026-029-Q1-E1-F1
aaaaaaaataagcaaaaactataacaatcaaatctaaagtcaaactaaaaa

SEQ ID NO: 8057 - DNA, 413 bp, Diabrotica virgifera
  Clone ID: LIB3026-029-Q1-E1-F11
cagcaaaatttttagcgtattgtagctaataaaatatgtacacgattcgcaaaaagtatctgaatataataggagactgcttatttacatatacatacatattatcttggttttctaattggtagcgtttgattttgatccagcttgcattctatatatttacaaattggtcattttaatacacattttatagtatattccatctgaaaacaaaaatttcaataaatattttattttctgcacttgcagtataattttttatataacagattgtaaaactacaagtcactgaattataatttcatatttctctggtactatttctactttttctctgtactatttctcgtataataagcaataactccttacacaaaacaaagatcacaattttcatatttcatagaaaagtt

SEQ ID NO: 8058 - DNA, 455 bp, Diabrotica virgifera
  Clone ID: LIB3026-029-Q1-E1-F12
gtcaagaattaccgggtttaaactcgtaaggatgtgatatgaaattgttaatgtatgtcttctcgtgtcaaaaaaaaatgtttcgttaagtactatcaattgtacttttttaaagttttatttttgtagtttggtgttaagaaatttatttcttttgtacatattaaatataattattctataaggtgttttaaataaagtctaaacaggtaaaaaaaaaaaaaaaaaaaaaaaaaaaaaaaaaaaaaaaaaaaaaaaaaaaaaaaaaaaaaaaaaaaaaaaaaaaaaaaaggggggccccccaaaaggttcaaacctaagttacccttgaatgaaatttcaaaccccttcaaaattttccccaaatttaaatcacagggccttcttttaaaaacttctgaacgggaaaaaccttggttttaccaacttaaacccctttgaaaaaatcccccttt

SEQ ID NO: 8059 - DNA, 336 bp, Diabrotica virgifera
  unsure (1)..(336): unsure at all n locations
  Clone ID: LIB3026-029-Q1-E1-F2
ttttattgttttctgacancagtanaacgtattttgaaatagataaattacatagattcttcgttttgtctcaattaatttaattaaataaaaatgtttaacaccctggacgccgtcactagtatggcgtatatgccaagaattcgtaatttaaaaatacaaatcgacctgtttcgggaatttctaataatgctgtttatttggctgataatgaattgatgcgttgctttgtggacgcactgtatattaaagatatagcggaaaaccgtattacaattatatttatacaagtatggtcattaacatgattaagtctaatggctggtttccaaaata

SEQ ID NO: 8060 - DNA, 308 bp, Diabrotica virgifera
  Clone ID: LIB3026-029-Q1-E1-F3
accacgagtccggttgaaattgcaccagcattttaataatatatgcacaatagcagtggctcttggaaaagttggagcatcatgtgattgcgatacctgctcacaagaatgtgaaagcattggctcagattatgttggaggcatttgttaccaagacgactgttattgtgcatacattaattaaatatgttgaaattgcaccagcattttaataatatatagttttttaacatgtaaaaaaaaaaaaaaaaaaaaaaaaaacaaaaacatataggcgcagcgccccccaaaaccaagacaaaaacaaa

SEQ ID NO: 8061 - DNA, 147 bp, Diabrotica virgifera
  Clone ID: LIB3026-029-Q1-E1-F5
agaaaaggcaacaaagatcatgcatagcattgctagtctagcacagaaggaatatagaatttcgttccgacagatgagaatatacctaagtacaatacttgcatcaattgtagggtacggttcaagtgtatgggcacatagactaat

SEQ ID NO: 8062 - DNA, 425 bp, Diabrotica virgifera
  Clone ID: LIB3026-029-Q1-E1-G10
actacgtcaatcatttagcggtttctggcgttactgcctggtttttccagtcaccaatacacaactttattacccgttttggtgtttttttttataaattgcagtgataacaaggattgaaaatggttcgttctcatcatgtagaaggctatgataattttgtcaattttatgaagaacttcaaggcacaaggaaccgtagtttgtatttattttggtggctctgtagacgaagcgactggtgaaagttggtgtgatgattgtgtaagggcatggcctgtaataagtaaggtacttgaacagctagacgataatgtggatttcatacatgttgaagtaggagacagaccaacatggaaagacccaaacagctcctttcgtaaggatcccaccaccaaactgctcgttttaccaactttgctcaaa

SEQ ID NO: 8063 - DNA, 363 bp, Diabrotica virgifera
  Clone ID: LIB3026-029-Q1-E1-G6
agccattctccattactaatttgcagttggataacctggatcattagctattgcactaccctgatgggattcaataacgataacgggttcgaatattcgaaggatgaagagcctactgcattcttgcaagttaagcacaggcaagcagctcctggcctttcacctgctgttgaggtccccctcttcaagatcaatcaggtctatcacttcctgatattcacaaagtcaaatcaccgcgctaccatatccatactcacgtatccctacaactaccatatcacgtgcacttctgccatcaagaggttggttgaattcaccgactgtccccacctatgtaatcccggattacacccatttgtgaaa

SEQ ID NO: 8064 - DNA, 416 bp, Diabrotica virgifera
  Clone ID: LIB3026-029-Q1-E1-G9
agacaaaaatgaagattgttttattagttttgttcgctgcttgtttgtcacatgccaaaataaatcaagatatacatttcgattgggtgcagtataccggagaaataccagagaatgctataataggcggatcaactgctgatggtgatccaacgtatgtagcccgttcgttcctcagtgcagatgaagatgatgaaaattactctggaagtgactacaatggttatgtagctggtggtgtgttacctggaaaattgtcgatcgacctttgtactccgcagagtatatacacgctcacaaagaacattgagatactgactgtggtcaatggaacaaaaatcgaatggattagatcttaccagcgcacattcatggacctcttcaactcagacgactatcgtcctgtaaggatcggc

SEQ ID NO: 8065 - DNA, 292 bp, Diabrotica virgifera
  Clone ID: LIB3026-029-Q1-E1-H10
cccacgcgtccgcccacgcgtccgaatagcttaagggaactggttcagaccaaaaaggaatcatgaatgttttgctagttagatatgatatttattgatacatttgtatgtcacacgtttttcagatcttaataaaaaaactttaatttaaaaaaaaaaaaaaaaaaaaaaaaaaaaaaaaaaaagaaaaaaaaaaaaaataaaaaaaagaaaaagaaaaaaaaaagtaaaacataataaaaatatagcaaaatcttttaagaaataaaataaacttaaaattaaaaggggg

SEQ ID NO: 8066 - DNA, 73 bp, Diabrotica virgifera
  Clone ID: LIB3026-029-Q1-E1-H11
tattttttttttttatacattatttttttacaatatatattttattacttggggtacctctttctccttccat

SEQ ID NO: 8067 - DNA, 419 bp, Diabrotica virgifera
  Clone ID: LIB3026-029-Q1-E1-H2
ccgcaatttttagttttttaagttttaaatgggcctctgggtttgcgtataatacgaataatataattgaatttcaagatgcaaattttttgaaattaagtttaagaatgtcacaaacattcttcagaatcagtatgtaatggcatattctacatcagttaatattgtaacataacctcaatttttctcaggtaaaacttgcaatagtcaatctttaaaatactcaaaaacgttgggaatggtagattgtctcaacaaccagaggttgtgttgaaatgttttacgcataaagttattaggtcaaaatctgtgatatacgaggcactagaaattgcgtcttgatttgtgttaggtcactcgttataactttttatatattttatgaattacttatatgttctatctttattatagtatgt

SEQ ID NO: 8068 - DNA, 312 bp, Diabrotica virgifera
  Clone ID: LIB3026-029-Q1-E1-H3
attttaattaaattattagttaaccgttaaaaaaaaaaaaaacaacaaggaaaaaaaaaaaaaaaaaaggaagacacacaagggcggggacgcaaatctttcgcgatcttggttgatggaacgctcaacgacatcgtcactactcatgtcagtaccgggactctcttcatcggtcgtcctttctgtttaacctcacgtgttccccagtgacatcgccttccttcaccccgtcctatcgccaccccctttcgtaaccgtggcttgtttcaagatggcccggcccaatcggcccgccctacacatggctttcgt

SEQ ID NO: 8069 - DNA, 196 bp, Diabrotica virgifera
  Clone ID: LIB3026-029-Q1-E1-H4
acatgcctttcaattggtcgttaaaagttggatgaacttcgctgtttggcttaaaaactaggccaatattgactcttcgaatatgcaacttttttccgtatatgagtttagggcgatgttttagtgctaaatgatcgaagtagatatcataatttttatatttagataaatattaaaaaaaaataacaaaaataaa

SEQ ID NO: 8070 - DNA, 391 bp, Diabrotica virgifera
  Clone ID: LIB3026-029-Q1-E1-H7
acccacgcgtccgcccacgcgtccgctctcgtccgttcctgtgtccagattatattttcatacattgggaaagcgggtctaggatggctcctcggggtacacagattgttaacggaagtttttggaacggaggcgaggcgaacggtactaccgcagcttcttttttcctttgttactggatcatctgtcctgagaggtaacagaatttgtattttataattttttttatttaattatattttaggtatgttaaaactgaacgtatatgatgaaaataatgactgattgtgtattgttgaatccgattcggcagtacttaatacatttgtttgtaaaattttgagttttgctgttaatcattgtatatatgataaatatattattttacaga

SEQ ID NO: 8071 - DNA, 391 bp, Diabrotica virgifera
  unsure (1)..(391): unsure at all n locations
  Clone ID: LIB3026-030-Q1-E1-A11
atttcacgatgaagctaatactttttggtattgttgtattgttatattttaaatactgtactgaagagggtagtgcactaaactgctatcagtgccaagcgaaggttggaaatgggtctgactgcgaaagtgggaaaagtgattctaatactacttgccagtcttctccagacagcaatgagacacttgcttgtttctctatagtagtaaatggctttttttataanaagttgcgacaaaactactttatgcaatgatgaaccaccacctggatatgatataaaatggtgtaaaagttgtactactgacttatgtaacactcacacttcttcttcctctattattacaccagctttattcactccaatcactatttttaccgctgtactaa

SEQ ID NO: 8072 - DNA, 332 bp, Diabrotica virgifera
  Clone ID: LIB3026-030-Q1-E1-A3
gcgtgggcgcagactttattatgaagtcggtacgacgaattgaataacgacagacatgttaaaacagtttttaagacccttttctctatcatatgaaagctataataaacatatagtagttcaatctaaaatgtttgcaaggcactcaaaatgggcaaatatcaagcacataaatggtgccaaagatgcacaaagatcccgactttttaccagattaggacgacaaatcaaagtggcagttcaagaaggaggatctgttgatcctaagaaaaatctacagttaaatcaggttatagaacatactataagagctaatatgccagcagctactg

SEQ ID NO: 8073 - DNA, 458 bp, Diabrotica virgifera
  Clone ID: LIB3026-030-Q1-E1-A7
ggggccccccacgcgtccgcaaataatcataatagaaaatcattaaatggcagtgtttatagatcaagagttacttacaacagccaattacttcacctggtactcaattttttatagaacatcagactttttatttatacatcctgtagatttgtttactttatacagatgaatactgagtggcagtattatacatagagcgggtggtgattttttttaaaagtcgccatcttaagtggttgagaaacgtttaatagccatataattctttatttattatcggatatagtagtcaatgtgcaaactaagtgtcagtataactataattatgttctctttgtatattagatgttaaccagagatctgttactaaatatatttttaagtagtagaatcagttttactgttgacggtttgtcacttagtctgctatgtctgtttaaatgcaaaggctattt

SEQ ID NO: 8074 - DNA, 446 bp, Diabrotica virgifera
  Clone ID: LIB3026-030-Q1-E1-A9
acgcgtccgcaagccaaatttttggtccaaatttttaagcagtcactattcgacaatttcaatgtatacaaaaaaattcaagaaattaccgttattttagtagtgtgctcctaataaatattcagagactttaaagtttgaagtgtcaatgcttatatagtcgagacatcttagtccctcgttttccagcttctttttcagatcgcttgcgctctgtagattactgatggataatagaagatatacaatcgaaacgacataatatataagaacctttgaatgtaactattaaaacatccgctatatctatttttggaaaattaagtgtaacatgatgcagtagagttcatttgaaactttttttaaaacagatagtcttagcatgtatttgtcaactgatacaatttcaaaatatttagctttttaacattcccatcaattccgct

SEQ ID NO: 8075 - DNA, 475 bp, Diabrotica virgifera
  Clone ID: LIB3026-030-Q1-E1-B10
ccggtccgcaattaacggggccacgacgcgtccgtgagaaatggtccataaatttgcctggtcgttcttctttggatgtgccttttatgaatctggtgtccactgatagttcgactttggattaagtgtccgattccacatttattttggttattgagttttggattcctttggtatgtttattattggtattatttgacattagtgagaattgttccataaatcttcctgattgttcttctctggatatactattatgaatctggtgtccattgttagttcagttttggataaagtgttcaattctttacctattctagttactgatttttttttattcactttggtacatttacttttgatatggttcgaattggctcacaccttttcctggttgttccgttcttggatataccctttataaatctgatgtccatggatagttcaattttgggtttagtgcccaattcgacac

SEQ ID NO: 8076 - DNA, 147 bp, Diabrotica virgifera
  Clone ID: LIB3026-030-Q1-E1-B6
caacaggcaaaaagtgcatccacgatcaagtacccgccttctatgctaacactggaaaacttttgggtgaaattgctacatgtgctgctgcctaaattattagaagatgttatgaccttttgcaaaaaaataaaaaaaatttaacat

SEQ ID NO: 8077 - DNA, 192 bp, Diabrotica virgifera
  Clone ID: LIB3026-030-Q1-E1-B8
ccacgcgtacggaatccacccacgcgttcgatgaacacaatcagtgtcttcatctcttttatctggaatttaaggtttacgtcaaacaccccaacttttttcacgttccaacatcactctatgggggggtaaacacttacaaacctcctttttatggggacacaaccactttcactttcatctcattcctcc

SEQ ID NO: 8078 - DNA, 58 bp, Diabrotica virgifera
  Clone ID: LIB3026-030-Q1-E1-B9
ggtcatttctatggaggtcgtttcgatgggccttcccagggtttgccctggttgaatg

SEQ ID NO: 8079 - DNA, 402 bp, Diabrotica virgifera
  Clone ID: LIB3026-030-Q1-E1-C2
taaaagctgccacgaacgcgttggatgaacacaatcagtgccttcatctatgttagctggaattttaggttgaagtaaaaaagctcagtctttttttaaaatgacgagagagactccaatagagttgttaaaaagctaataattaagttattttaagattaaattcaattaaattataaatttatataaatggggtgattaaataataaatttaactttatttaaattataataatatggagtgattttttgatccatttaacttgattaaaagaataatttaccttaaggatatcatggtccatttattgtggagatcagatcgatttaccttattgataccaccatgttggaatagggtagatcattgctgtagcagctatagtaacaactctgttcgac

SEQ ID NO: 8080 - DNA, 438 bp, Diabrotica virgifera
  Clone ID: LIB3026-030-Q1-E1-C5
caaattcaaacaaaactttccccattccaaagtgcctagccaatcagaaacatttatctccccaccttcctttttttttttgaaatacaaacagtcattctctcaaaaatattcctacccaaacttatgactttccggaaattatgtaaatattcctatcattaaacaatcatatttaaaattccaaactttctttaccttaatttcctaagaactaattaatgtggtttttggaatcgtgcataacaaaacaccgttataatctccaaataccctgaacaataattattgtcttattcatatcactttctttcctaatgtgttttatttttcagggaaaaacttactaacgataaatcacttcttaaaaactacttataataaatagttacaaatcaatatacagggtggatcaaatttatgtgcccgcgttatatt

SEQ ID NO: 8081 - DNA, 395 bp, Diabrotica virgifera
  Clone ID: LIB3026-030-Q1-E1-C6
cacgcgtccgtatcttatattatgttggcgtttgggtatagttcttcgagctctttgttagttattatcctatattgtcctgctgcttcatcaagcatggtcccaaatatcttccttgggatttttctttcccaacaaaacaaggctacaatttcaattaaaaactagcatggacttatctcacctaataaaatgacaaatattaataggaatttccacatagtttctgacgtactatggtttatagtgcataaagtagccggttccacaaagccatgttaactcactttactgaaccgataaagttaatactttatatttattatatacaaaaataatttaatgggccttatcaggtgtcaatttcgaaaaaaaaaactatgtattgtgtgaca

SEQ ID NO: 8082 - DNA, 178 bp, Diabrotica virgifera
  Clone ID: LIB3026-030-Q1-E1-C9
ttgtcgaagggaactgatgttttatattatacattttatatattacttgaatatataaatttaaaataaaaaaaacaacaaaaaaaaaaaaaaacaaaaaaacagaaaaaagaagacaaaaaaggaaggagcttcaagggcccgaagtgaaaatttaccaagtacaatgtcccaggga

SEQ ID NO: 8083 - DNA, 422 bp, Diabrotica virgifera
  Clone ID: LIB3026-030-Q1-E1-D5
gaggcgtagtaagtacgccacacgtgtagttatgatataatttgatacgcgggtagttagaggttaataaactgtctcaaaataggtactgtttccacctttttctgacatccttttcgtggattagtattttattttcatctcagatacatctaatctgattaaaatcttttgctttctttgttctctgtttggcattttatatatctttgtcttgccctccctggtattaagttgatcccataaatttgtatacgcttctgctttagcatatgctactgctactttggcgacaatatagttttaaagatctgtcagctccattttcttgccattttttatggagtgtttcaaaggtacctaatagttataactttttgtcaaaaaaaaaaaataaaaaaattttgaataaaatttttttg

SEQ ID NO: 8084 - DNA, 440 bp, Diabrotica virgifera
  Clone ID: LIB3026-030-Q1-E1-E3
gcgtccgccaacgagtccgcggacgcgtgggggaatttgtaatgaaaaaaacgtagaaatatatactacaatgaagtttttaagatcgacagtgtgctacattgccatcttggcaattctctttaccctctgtgccgatgaggttgaaggaaggagaaaaattttgatggggcgaaaaagcattaccaggacatatcttcgtggaaatgctgttcctgcgtatgtgataataatccttgtaggaattggtcaaatcatcctgggagggatattgtacgttgcattgaggaagaagatcattgctgcacctgtaacggcatcatatgcagtggctagacaagaaccataaattttatttgtctagaatattattttctaaatatgcatcttttttaaattaatgtctacgtaaataataagtctagaaatatataaaaatt

SEQ ID NO: 8085 - DNA, 413 bp, Diabrotica virgifera
  Clone ID: LIB3026-030-Q1-E1-E8
ggggccacccacgcgtacgacaaaacagaacagtattaaactgcaacctatgaaaggagtctacaatatgtgagaccaagtccagtatgccaagtactgtggatttgtcctttctaaaaccgaactgagagtctgagaaatagttattatttttggaaataatataaatatataaataatataaaatatataaatggaatctatctggttaaactgttccatgttttgcaaaatgtcagttttatagtagagtagatttgttaaagttgagatttattttggcaaaaaccatgttgttggtcggatattaaacctttgcatagccaactcaactgcctgctgacttgggaatcaaacagtttcggtattgaagaatgtatacaaacactacaatacttttctacttgattttt

SEQ ID NO: 8086 - DNA, 394 bp, Diabrotica virgifera
  Clone ID: LIB3026-030-Q1-E1-F1
aaatagtatttagtattgcttcgacgcgtacataaatatgttttccagcaaactttttatcatttttatcttatttttaagtgttgaaatatgtatttcacattcccattctcatggagaccaccacgggcattcccatgacgagcctgcttcattcaaatattcaagagcagcgaatgaaccagaccaccatgagcatgttcatactcatgaacatgtccatgcccatgaacaccatggagaagtaccccataaatctaaaaaccaattaaatactcaggagttgtggatccaagcaatgggttcaacgttacttatcagtgccgctccattttttatattattctttgtcccgttagacaataccgaaagcagccagcctcttttgaaaata

SEQ ID NO: 8087 - DNA, 387 bp, Diabrotica virgifera
  Clone ID: LIB3026-030-Q1-E1-F12
gaacgaaagtaacaaaatggtttagtactctaaaaattttgtatctttggatgactggcatatttattttaaatttctgggtcaaagagcatgacgtcaataaatttgtaacgtaaatatactgtagaactgtgaaatcgttcaatattacaagaaattagataaatattgatacaaaaatgtacttggcacaaatgtacaaaggtttacttggcagtaaattactcatggtaactctggttaaaacagttcccatcatttgtaacgggtagctttgttagataccaaactcaaatagcattataaaattgaatcatggagaatgcatctatcgagaacgctaagattcactgctgattcgaacaaaagatatggttaattgacacg

SEQ ID NO: 8088 - DNA, 341 bp, Diabrotica virgifera
  Clone ID: LIB3026-030-Q1-E1-G10
aaataaattttaaatgtaacaatttctacatttacctaaattgtacataacaaaattttgtgaataaaatgattctcgttatttcgataatgaactgtgaatataatctttttaatttttaagttacaatgaatattggatatgaacatgtgagcacgttgtataataacttccagttgatgtcaagattgaccaacatatcagaaattaatttgtcacagtgattagagaatctttcattttattcttttttaaatatccactagatgcctttatctatacaaaatataagttgatataagacatcgagtaatatgacgaaaattatgccgtgcattttg

SEQ ID NO: 8089 - DNA, 339 bp, Diabrotica virgifera
  Clone ID: LIB3026-030-Q1-E1-G6
ccacgcgtacgcagacgcgtgggaattaactctacagctacttaaccatttgcgaatgcataaccacaaactgatctaaaatgtaatgaatcttttttcaaaccgttcaccgagtcacgtaaatattaatatgtacataattaatacgtacgaaaaactgaaatgaaaaaaaaaacttgaaaataaagaagttctcttgcgaaaaaaaaaaatgtaaaagaaaaaaataaaaaaaaattatttgaaataaaaaagaaaaacaataatagataaaacaaaatttttttaaaaaataaataaaatttacataaaaaacaaaaaaaagggggggccccccaa

SEQ ID NO: 8090 - DNA, 328 bp, Diabrotica virgifera
  Clone ID: LIB3026-030-Q1-E1-H10
aagaaataaattaaatttatttattaacaatatatttataattaaatatttttatattattaatattaaatattttaagggatgagcttaataataaaattttattaaaaattaatttttaaataaaaattaggattaataattttcagagtttaaaatatgttaatatttatgtttatatagtattatttttaatgtttataaattttttattagcatataaatttaaattatttatttttagtatgtgatgatgtattaagtataaagtcattgtagatttattattaatataaaggtttaccaaatgaattcagtatcatttttt

SEQ ID NO: 8091 - DNA, 288 bp, Diabrotica virgifera
  Clone ID: LIB3026-030-Q1-E1-H12
acgcatccggagcttcttttgttgttatctcatttatatttaacgtttaggattaaaaattttcatatttgaaaatatgttattaatcattttcatatatggtaagtttgattttttcatcgactttttagtaatctatcttttgaggctagttccatttagtaatgaggatgatatgagtactaacaatgtgtcagagtatgcgtatcagcaacgggtattaatggaagtcggcaacatgtgtgtcaccggtttattaaaatcatgtccttttgtattaaatcttga

SEQ ID NO: 8092 - DNA, 282 bp, Diabrotica virgifera
  Clone ID: LIB3026-031-Q1-E1-A3
catagtcacaaatttacactctcttccattcaattaggacagtagctagaattcctttaatagttatcaatctactagttattgtgttgaagctaatactcggatgatatatttaattttaatgttaggaattagaatttgtgaatcctttatgtatttgtatatattttgtataataaagaatttattataaaaaaaaaaaaaaaaaaaaaaaaaaaaaaaaaaaaaaaaaaaaaaaaggaagtagtaaaaaaaagggcggaggttcaaaaggaataaagg

SEQ ID NO: 8093 - DNA, 411 bp, Diabrotica virgifera
  Clone ID: LIB3026-031-Q1-E1-A4
gaaataataagtttaatttaaaaccgaagcaattaatggtaaaaataataagtttaaaaattaatggaaatggcttaaaaaatcaaatttttttttaattaagaaataataaataagaaaaatttttttccaaaaattttttaaacaataaaatttgtgaaaggttcttagggtttagcaatttttaattataaaaagttcgtgtttaagggtaatgattatattttaactttttcttctttatgataagatttttatttagattaatttttttgattcctttatgttttaaaaaaaatttttgattaattcaatgattaatatttttttttacatttttatttttttttaattatggtagaggtttacattatttctctatttcaaatattttaggtattgatttttgat

SEQ ID NO: 8094 - DNA, 389 bp, Diabrotica virgifera
  Clone ID: LIB3026-031-Q1-E1-B10
attcgcgcgtccacccacgcgtacgagatgtatcacttttaaatgtttatttagaacagtttaaataaaatgatttatttataaaaaaaaaaaaaaaaaaaaaaaaaaaaaaaaaaaaaaaaaaaaaaaaaaaaaaaaaaaaaaaaaaaaaaaaaaaggaaaaaaaaaaaaagaaaaaaaaaaaaacgaaaaagaaacgtgcataggaaagaaaaaaagaaaaaagagggggggggcccccctgggggtccatcttttataaccgccgggcggggaataaacctccctctaagggcccccgtagttttaaccccagggccgcgttttaaaaactggcctcctgggaaaaaccggggttaaaagggcgacgccccctgggtgcaaagccc

SEQ ID NO: 8095 - DNA, 174 bp, Diabrotica virgifera
  Clone ID: LIB3026-031-Q1-E1-B8
actatggcttaattgactgttacatatcttttgacaacagcttcttgttcaaacagatgatcaaaatttattttacaaggttccagtctacaaattcatggaagatgtaagactttcaaatccaaaggaaatagatttacaagatcattggattattcaaatttcacttgtcgt

SEQ ID NO: 8096 - DNA, 424 bp, Diabrotica virgifera
  Clone ID: LIB3026-031-Q1-E1-C1
cgcgtccgagatttttgacttcacagtatagtgatttgactttgtcgaaacttcttaactaaccagttgtgcattgctgtcaattattttacttgtccatggcatatccttttgcaacagcttcgagcattatttgtgcaacacaactacatgcgcatgggatgtagccacgttaccaacacttcagtattatcaatacttctttaggttttgtgtcggtgttcagatgctggctgtcatcattttacatttttctgaaactgatctgtatcggctgctgcgcgaaataattctaataccaaccatcaaaatttttttcgaccaatccatctctttccctcctcttttccttataaggcgaagtaaatagtagttaggtcctcgaaatctatgaccgaagtattctgcttttttcctccttttg

SEQ ID NO: 8097 - DNA, 124 bp, Diabrotica virgifera
  Clone ID: LIB3026-031-Q1-E1-C5
agcccacgcgtccgcccacgcgtccgggcactcttccggcatttgattgaaataagtataattcatttaagtactaaatttcatggcataatccgtttatctcactcgtgtgatcaaagttttg

SEQ ID NO: 8098 - DNA, 307 bp, Diabrotica virgifera
  Clone ID: LIB3026-031-Q1-E1-C6
agatctagatcgccaactagcgcccatttatcctttccggagtactcaagtttgagtacgtttttttcagtagtttggtgtttgtattattgtgctagttggtgttaaaaatataaatgttaaatagagaatttcaaataaatatttttattataagcccgattaggactgatttagttttaagttttattaaacacgagtttctttttttataataaaaaaatgtatcagaatatccgtaatggttttgtgtaactgtgcacctgtaaatgttctgtaactgtatgagtatgtgcagatttttatt

SEQ ID NO: 8099 - DNA, 368 bp, Diabrotica virgifera
  Clone ID: LIB3026-031-Q1-E1-C7
acaatctagatcgccaactagcgcccatttatcctttccggagtactcaagtttgagtacgtttttttcagtattttggtgtttgtagtattgtgctacttggtgtaaataagacatatgttaaatagagaatttcaaataaatatttttagtataagcccgattaggactgatttagttttaagttttatgaaacacgagtttctttttttataatagaaatatgtatcagaatatccgtaatggttttgtgtaactgtgcacctgtaaatgttctgtaactgtaggagtatgtgcagatttttattaactaaataaaactatggaaaaaagtcaaaacacctcaaaaaggacattaaattccactt

SEQ ID NO: 8100 - DNA, 232 bp, Diabrotica virgifera
  Clone ID: LIB3026-031-Q1-E1-C8
acgatatggctgaattgaatgttacatatcttttgacagcagcttcttgttcaaacagaaaatataaatttattttataatgttcctgtctacaaatacatggaagatgttagactttttaatccaaaggaagtagatttacaaaatcattggttcaataaagtttctcttgtcttgtatccattacatactgtttaatatctgtgttaatagataaagaagtataactcat

SEQ ID NO: 8101 - DNA, 544 bp, Diabrotica virgifera
  unsure (1)..(544): unsure at all n locations
  Clone ID: LIB3026-031-Q1-E1-C9
cgcgtgcggttaaaagattttcagtattttaanaatatggttattaatttaattttatatatattattactttttaattttttatagaattttttaattcaaaatatagaattttaaattaatttaagatttaaagtaatggatgactaatattaagtaattacacaaaattgggtatatttacgtaagaaactataataaggggtttcaataaaggggaattccgggcaacaattnntttttcaaccctggtnnttattnnaaaaacaatggtccctttttggnntattaaataaaataaagttctccgccctgggcccactgggattaatnnttgaatggggccgcgggggtattttgggaccgtttgctaagggtangnncataatcaattaagtnnttttttatnnntgaaagcctggannatgaaggggttgngnnatgaaannaaaaaaactggtcctttaatttaaatttaaataaagaaattttaatttttaaagtttaaaaagctttaaattttttttaaaagacgaagaagacc

SEQ ID NO: 8102 - DNA, 220 bp, Diabrotica virgifera
  Clone ID: LIB3026-031-Q1-E1-D4
atgagtttaaggtaacgtgtaaatagatttgtaatctactacgttgctggtagatggatctctattcgaaattgggattacattacgaattacctgaatattttattttggtatagatattatatctcaaggtagataactacaaatttgctggggtgcataaattagaagatccggattgggaattgttgctccttttttttgggtgccttagaaaaga

SEQ ID NO: 8103 - DNA, 418 bp, Diabrotica virgifera
  Clone ID: LIB3026-031-Q1-E1-D6
acgaaaagcgcatatcggcatagggtagactttgaattaggagataagtagaactattttcaaaatttcattaaaatccatgcagtaggatagaatttggaggtaatagcctgaccttgctctcattgactggtgtaaataatagcatactattctttttaattctttattataatttattgttctatttcttgtaaatgattttaaatagtttatattgtaaagaaatttttgtaactctgtaagtgtaaataatctttgtaatctttgtaaagacataataaataaatacagatcataatattctttattaattctttattataatttatttttatatttcttgtaaatgattttaagtagtctatattgtaaggaaatttttgtaatctttgtaaagatataataaataaataaa

SEQ ID NO: 8104 - DNA, 407 bp, Diabrotica virgifera
  Clone ID: LIB3026-031-Q1-E1-E1
aataaaatcagagtaataacaaaatagttgtagactattcgttgacaagatgaattcaagtattttggtagttttaatgtgtttgtgcgctgcacaatttgctttcggctcacagcatgagattaaagatggaaaatgttccaacgcatctcaggatgatctagtatttcgtgatcatataaacaaagcttcaattcctttcattaaaagagatgagaaggttgaatggcatggagacacaaccatttactgcctacaggtcaccaccgatcaagatgaatcaaaaggtgctacagctactgtaaaggaaggaggtgttggtcattcttttgtgaccgtcaaagtagagtctggtagaggacatagtttggattattacgtaaaagtttacgctaagtaataaatgt

SEQ ID NO: 8105 - DNA, 322 bp, Diabrotica virgifera
  Clone ID: LIB3026-031-Q1-E1-E7
acgagattattaattaggaattatatatttattattttcgaatttacaacagctaacactttaaaatttttattgtcaactatatattttaaacaatttttatgacattaaaggtgattcgtttttacatatgtctaaatttgtaagaaataatttacatttatttattaacaatatatttataattaaatatttttatattattaagataagatatttatatggatgaccttaacactatcattttatgaacgtttactttttaaatagatattaggattaataattttcatatttcaaaatatgttaggaaatagtttca

SEQ ID NO: 8106 - DNA, 287 bp, Diabrotica virgifera
  Clone ID: LIB3026-031-Q1-E1-E8
agatatttttattttggaaaaccacgaatttaaggaacattttttgtacgtatgcttctaaaatattatatagtacgattattttgaaacatgtatttaaacaatttaataaaaaatatttatttattaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaggcgaaaaaacttaaaaaaaaaatagatggggtttcacaccatag

SEQ ID NO: 8107 - DNA, 413 bp, Diabrotica virgifera
  Clone ID: LIB3026-031-Q1-E1-F2
acacgcgtccggtccaagactgacctacgtgatctcaacgaaagacaagaattagaactagcccaaagtttgttgccaagcagcctttcctgggacagcgttagtgattgttatcatggtgaacgaggaactgaacttttattaggatatgaggaaaggcaagcacagcttaatcctgaattaccttgggtaccaaatataagatttaacggcgtctacgatgcagaagtagaataccaagctatggtcgatcttacagctaccgtttgcaacttactagaagataacaaaccagacgtttgtaaagatcatgtgacaaagactcatcctaaaaatgcttaaaaaaataaatgtggaaagtaatgttggttgagggttaattcaattttcgtaacaaataaattatatttggt

SEQ ID NO: 8108 - DNA, 388 bp, Diabrotica virgifera
  Clone ID: LIB3026-031-Q1-E1-F5
aatacccttgtaagattgtattattacagtatttttgatcgtattataatggcaactttattttaacaacacaggttttcctacactaattatgcttcactttacaaattaccggaatttggtggatgcaatttcatcaatttattttaagcgggataaaacataacatatttttatgttgtgggatgaacttagtgcatttagtagtaagtttgctgtcctctgttccaccatctttaaattaatttattgtagttttgacatactatgtgcaagcgcattgaacatataagaaagaatttgtatatttgaaaaattatgctatgaaaactcttaacaaacattgtagagctgatagatacgtattagtggacaataccaaaaataa

SEQ ID NO: 8109 - DNA, 405 bp, Diabrotica virgifera
  Clone ID: LIB3026-031-Q1-E1-F6
agagttggtgcaactggatattaatattgaattgattaaaacaatttacaacacgcagtattcaggttaacaactgaactctaaagcccgtacaatttgacttatatactacgagcctatgttctccactattctagaccgggcctggaacaaaaagaataataccgaatgaatagaactaaatgtatctagacattctggcgccggcgaataaaaggagtgaaaggggtcgaaacttgttctcggctcgttcgacaccttgaagattcggtagtcggtggacgggtcaggaccggcctacgtaatattgggaactgtaacaatattaatatctaactttggtttgcaggtgcagaagctcctcgtgctgctggacttggagcagactgcgaatgtaacgcatgc

SEQ ID NO: 8110 - DNA, 310 bp, Diabrotica virgifera
  Clone ID: LIB3026-031-Q1-E1-G1
caagccttcggacaagccttcgggaaacgttaattataagcccccaatggacaaaacgtttggactggaacaaaatcaaccaatccaaatttgggaactaatccaaaattcaacaaacaactgaagactcactgggaaaagatcaattataacggtggttgggataacgctttccatagatatcaagtggaatggacgcctgaacatattaaattttcctgcgatgatcaagaacttggtacaattacacccccatctggaggcttctgggaatacggtgatcttggaccatctggattgccaaacccat

SEQ ID NO: 8111 - DNA, 389 bp, Diabrotica virgifera
  Clone ID: LIB3026-031-Q1-E1-G12
aaacagtatggacgtctccaaattgttattgatttgcacttttctcgcctgcgctggtttgagtacccaaacatcacctgaagtaaatttaacaatttattatgaaacttactgtggccaaagtcgacaaatgataaaagatatcctgatacctgcatatgccaacctgggagatattcttaaaattaaacttagcctcttatggaggagcaatgtacatgatacattcgaatgggtcaatcgaattcaaatgcagccatggccactatgaatgctttgtaaaccgaattcatgcttgtgctatcaatttatctccaccacaagcacagctattaaaattcattgagtgtgacctcagaaaatcaatgttcaatacaaatgatgaactt

SEQ ID NO: 8112 - DNA, 409 bp, Diabrotica virgifera
  Clone ID: LIB3026-031-Q1-E1-G2
ggggaactaaaagtacaaattgatagaatttaatattatcaaaatgcagagtgtaaaattgatacttcgcccattgcaaggatacagacgaatttcaaattgtgctgcattgtgccagtccgtagaggcccagacgaatcccgtagaaaaaatccaaattccaccccctagtaatgtcgaacaaccagtatcacctaaaatagataaactagccacagaaatttccaaacttaacttaattgaagtctcggaactaagttctgtcttgaagaagaggctcaatttacctgacgctcccgtcttcccagtgggaggcttcgccccagttgctgcacctgcagaagaagaggatgccgcccctaaaaaagaaaaatccgtgttcacagtgaaattgatgaaatttgaagaa

SEQ ID NO: 8113 - DNA, 402 bp, Diabrotica virgifera
  Clone ID: LIB3026-031-Q1-E1-G3
tgataatgctaaattggagacacttggataaaaccaatgatatcgaaaggtattcaacagttgtaatcaactccttgattgatactgctatagctcaaaagaagctgtatcctctaaaccctaaaatcagaagagcaataactgatgatggtatttatcaactagcagatgaagatgtggatatggtgcctgatgttatcaaatgcctgaatgtagcagcaatgagaaagccaacgttgttttctaagacgacttattacgacgtcaatttgataattgctaatatcatagtaacagtttttgggaataagaaggcatcacacttagccttagatattggcatgaagagaatcaagcaagtcttaaaggcagataattccaagagctttgatgctgatacag

SEQ ID NO: 8114 - DNA, 417 bp, Diabrotica virgifera
  Clone ID: LIB3026-031-Q1-E1-G6
aaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaataaaggaattcggcaacatttttt

SEQ ID NO: 8115 - DNA, 439 bp, Diabrotica virgifera
  Clone ID: LIB3026-031-Q1-E1-G9
cacacgcgtccgcataatttcaaactacaattgtggcttattcctaataaaaatagtaaattgtattaagatgccataagaaagtagcttcaggactatatacattgtgattcagaaatgtactaaaagagcgaaaccaaggttttgagcttccatcactgaacaatgtatcgagtccaaaatgattcatttcaagtgagaaagaacatgcatccatattgtacagccaccatctgttagtgcttctcgacaagctactgccaaagctagttctagagggtagtatttagcagccgaagttacacaaatatagaaacaagtttcatacttttaatgatcacacaatatttttgtggcttaacttcgcaggacattagtcccactgagaatatttcgggtgatacttgcaaagacttgaacacttaaattaatgttacct

SEQ ID NO: 8116 - DNA, 421 bp, Diabrotica virgifera
  Clone ID: LIB3026-031-Q1-E1-H11
acgcaaaaaaattaaaatttttattgtaaaataaatattttaaataatttttttgtaatgaaatgttattcgtttttagatatatctaattttttaagaaataaattaaatttatttattagcaatatatttataatgaaatatttttatattattaatattaaatatttttagggatgagcttaacaataaaattttattaaaatttaatttttaaataaaaattaggattaaaaagtttcatattttaaaatatgttattatttatctttatatattattatttttattttttataaattttttattaaaatataaatttaaattatttaaatttagtaatgatgataatattagtattaaaaaattgtatatttagtaaaaatatataggtttaataaaggaattcggcaacattttt

SEQ ID NO: 8117 - DNA, 313 bp, Diabrotica virgifera
  Clone ID: LIB3026-031-Q1-E1-H5
accacgcgtccgctttttttttttttttttttttttttttttttttttttttttttttttttttttttttttataaaaaaaaaattaaaatgtaaaattgaaaaagggggagacaaagggaacggggcaccacaaaggagagacaggcaaggaagacaggagggggatgaccggagaggagtaggtaaagaacaactacaacaggggaacaagacgaaaagaaccaagtacaccaataagcaggagcgtaaagagactgacgtttgaaggaaacgggcagaatgatcaaaggccaagccagggccaaaaaaca

SEQ ID NO: 8118 - DNA, 389 bp, Diabrotica virgifera
  Clone ID: LIB3026-031-Q1-E1-H6
acggtggcaagaaaggcaaaggacaaatgggtgctctcatgggactgatgggacttaaagcagccatccttggaaaactcgccctggccagtattgccctcatcgctggtaaagcccttcttattggtaaaattgctttagttctctcagctattattggacttaagaaacttttgggtaacggaggcggcggcaagcacgtcacatacgaagtggttccacatgcatcccattcatcagctcacgtttctacacacgaaaccgcctatgctggtggttccggacacggaggcggctatggaggagacatcggcggcggcggctatggcggcggtggttccggcggatggggtaggtctctcgatgcccaatctttagcatacagggga

SEQ ID NO: 8119 - DNA, 177 bp, Diabrotica virgifera
  Clone ID: LIB3026-031-Q1-E1-H7
aggacgcgtgggcaaaaatttacaaagccgtcacgcagaggtggttatttttattttggatgtaattttacattatatttttattcatgtgatattcagtatcccatgtgagactgaatgatatttttattgtatataattttataacattggttacaataaatacggtgtttatat

SEQ ID NO: 8120 - DNA, 210 bp, Diabrotica virgifera
  Clone ID: LIB3026-031-Q1-E1-H8
agccattattaatttttacctgatgtaaaaatagttaacatggtttatgtgtgctgaaatgttagccgtttttcaagagagccaggtttttacgatatattttaaatttatataccaacaatatctgtagcataacaaatttctatataaataatggtcaatatttatagggatgaactgaatgtggaaagtttagcagaatttaatttt

SEQ ID NO: 8121 - DNA, 304 bp, Diabrotica virgifera
  Clone ID: LIB3026-031-Q1-E1-H9
aacacgatcaatccaattaggatgtttaactggaagattaatctcgcgattcctcaatactatccgaaatatttatctgtctaccattttgtacaataaaggaggagggaagacatccatgagtgacggccattgcatacgatttgcatatcctaatcatcgaatgtcataggacgtatttgggtcagaatgtcagtcaacgagaaaaaggctttgttgcacgtcagtgtacacctttgaaactcaagtttttgaagcttccacaacaccctttggtgcggaataccccgtgttccggtttgtg

SEQ ID NO: 8122 - DNA, 414 bp, Diabrotica virgifera
  Clone ID: LIB3026-032-Q1-E1-A1
aaaaaaaaaaaaaaaaaaaaaaaaaaaaaaaaaaaaaaaaaaaaaaaacccctatttaaaaaaacagataaacacctatttaacgaaaaatcaataaaacaactataaacacaaaaaaaaaaagggggggcccccctaaaggttccaaccttaattacccgttaatgcaacttcaaacccctccaaaattgcccccaaatttaaatccattggcctcctttttaaaaattccaaatgggaaaaaccctgggttttcccaatttaacccccttgaaaaaaatccccctttcccaaccggggttaaaaccaaaaaggcccccaccatttccctttccaaaaatttgcccaccctaaatgccaaatggaaacccccctttaccggcccataaacccccgcggttttgtggtttaccc

SEQ ID NO: 8123 - DNA, 373 bp, Diabrotica virgifera
  Clone ID: LIB3026-032-Q1-E1-A2
gcgtccgattacccaggagtttaccaagtaccagagagctgctgcagaaataccaaatgccaaagtatcgcttctctttacacgagaggttgtttaccgaagatccactatataatctcgcaaagtgctcttctgcttggagttggggctatgtgcataacattcattcagcttctcggtgctacatttgcccatcttctggccagatctattagaaaacttaaaacacagattgaagtggaaagaacaataagaagacaacaactgtacgagtcgcttgcaaaatctaacacacaagagaaagttagtccagtcctatacgtggcagagtcttctgaagcttaagaatttagtcgtgtattaaatataaaaa

SEQ ID NO: 8124 - DNA, 412 bp, Diabrotica virgifera
  Clone ID: LIB3026-032-Q1-E1-A6
gcgtgggatttggaaattgcagcatgtactgcggcagaaattgattttgaatgtcctacacctggaaatgaagcaaccttctatccagatccagttaattgcgctgagtatattgagtgttttgctggaaaggcaaatattatggaatgcccagcagatctatggtggaaccaagagaaacaatattgtgactttaaatccaatgttgattgcaaaatcgatccctcagctggaacagagcctccacgtacaacagtgacagatccaactcggccaacagattttactccagatcctcattgtccatacccttctaatgaaattacgtatgatttcgttcctggtaattgctcagaatattacgaatgtgaccacggactcagatatcttgaaacttgtcctcacaatagat

SEQ ID NO: 8125 - DNA, 452 bp, Diabrotica virgifera
  Clone ID: LIB3026-032-Q1-E1-B10
ccacgcgtccgtagagacgtgggcggacacgtggtctgatacgtgggccaagaccatggatgatcaatcaacaaatcaaggtcctttgggcgcaaagtgtcataacaaacctttcccttgttagtggattctgcttctaaacgatttaatttcaccaaatcgtatacaatgcaattcaatggctatttgtggaatataaggtaatgttgatgaaatcgccaaatatttggatgatcagattgaaggaattagatgtaaatctagaactcccataaatttgatgatcaactcatactggtttgatcaaactgacaccatcttcgatgggcttcgaaaattcttggaaaacacagttgcacgtgaagcaaaagataccttcttcgtctcagaaaaacaggtcctagattttataataaatcccgttaaacttagcgattttaaaactgctgacg

SEQ ID NO: 8126 - DNA, 412 bp, Diabrotica virgifera
  Clone ID: LIB3026-032-Q1-E1-B3
gcgtccgccagatataaaaggagttgcaaatttcgatggacaagcatatttgggtgattggatcgaacaagcaagatacccaactttactggaagatcatggagaatgtgttattaccaatattgcagtaggcgctgatggagttataagaagtcgtaccaaatatactaatacaaaaacaaacgaagaccatgttctagaaggagaaggagtatcaaattcaaccacaggagaagccaaattcttagtacatttccttaatccagatgtaactgtacctttttggattcttggtacagactataaaagatggtctgtaggattctcctgttttgaacgaaatggtgtttttctagagagtcttttcctcacgacaagatatcaagaaggtttcacagatgacatagataat

SEQ ID NO: 8127 - DNA, 193 bp, Diabrotica virgifera
  Clone ID: LIB3026-032-Q1-E1-B5
cacgcgtcaagtagagttgtgttgctaatttcgttggacatgctgacatgggtgattggttcgaccatgcaagatagccaattttactggcacatcatggccgttgtgtttttaccataattggagttggcgctgttggtgttacaggatctcttggcagatatactattacattggcgtgcttcgaccatgt

SEQ ID NO: 8128 - DNA, 428 bp, Diabrotica virgifera
  Clone ID: LIB3026-032-Q1-E1-C11
ccacgcgtccgaataaacaatggcttccaaaactgttcttttcggactcttggtaatccttttggtcaagcactctttggctagagatctgactgtcagtcccaactcagacaaagcaaccaaagctgtaaacgacaaagaagtagcaacatccgttgtaggaagcaccatccgtgttagagtaccagacagcttgttcttgaagaaaccaatcacctgcattgttattgtggacaataaccagagcgatagcgtacctgaagtagaagatggtggtgttgacagtacatgggtgaccgtaaacattgctctcgccattaccgaactgctcagctacagaatccaagtgtacaccaatgaataaatatagattgtaatatgtctgaattatgtacagtggtgctaataaaggctaatgtgtatataaa

SEQ ID NO: 8129 - DNA, 443 bp, Diabrotica virgifera
  unsure (1)..(443): unsure at all n locations
  Clone ID: LIB3026-032-Q1-E1-C2
gttctacattttagtcctccttaccaatattttaaaattttggggtanaaggaaaaatatgaatcagttcgtagtaagtgtaaaaatgacctatctctgactgatttctattttttatctagagtgttgaacaaaaattgattttcttcttaacaaagtgtgttggggaatttagttttaggtttcataatcattcataaattccgttttcaacttcattttaatcttaattattctacttataagatatgtagcatagaaattttatttgcgtattttatagttgacacaaaattatgtattatctagtatgtatttactaatccatcatgtatcatgaaataatatatttagattgattcattacatttataacatttgacgtagtttaccgaatttcaatgagaggaaaaccatgtagattactcacatttctaaacagc

SEQ ID NO: 8130 - DNA, 134 bp, Diabrotica virgifera
  Clone ID: LIB3026-032-Q1-E1-C6
ccacgcgtccgcccacgcgtccgaaaaaaaaaaaaaaaaaaaaaaaaaaaaaaaaaaaaaaaaaaaaaaaaaaagaaaaaaaaacaaaaaaataagggaggtcggtctaggtggttgaaacttccttgcgcttc

SEQ ID NO: 8131 - DNA, 466 bp, Diabrotica virgifera
  Clone ID: LIB3026-032-Q1-E1-D11
ttcgcgcgggccacccacgcgtccgcaaaattgttaaaaaaatgtcttctgttaatttttttattaaaagaagcttgtcaacaactagtataagatatggtaaaagaaattttaggaagttccccatatataataaaagaggaactaggatattcaaacaacaacaaatgcagaatccggacccagaagttcctgttcacaaaagaggcgtgcgggaggttggttatgaggaaagagacaaatttattacaattccagaaagaataccagaattaatagtcccagatttgaggaactgtcagttgaaaccatatgtctcctaacagaccccaagaagtctttcaatcggaattcacaagctgaggacttacttaatgtagtatatgctccaaaaatagtcaaagatttcaatgaggggaagcttgcagatgatggccagcctttagaaccttcaagggaagaaaaa

SEQ ID NO: 8132 - DNA, 368 bp, Diabrotica virgifera
  Clone ID: LIB3026-032-Q1-E1-D7
ccacgcgtcagaaagatgaaaaaaaaaaaaaaaaaaaaaaaaaaaaaaaaaaaaaaaaaaaaaaaaaaaaaaaaaaaaaaaaaaaagaataaataaaaaaagaaatttgagaaaaaataaaaaatcaaattgaagtgtgaataggatgaaattggacaaattgtagtggaggtgaattaagaaaatgctggggggggcgctttttggggggttcagtctgtttttggtgtgttggggatgtttagttttttttcggggggtcactcattttgttttggggggtttttttttaaaggtggtgatgggggaaaactgtgtggtttgcctatcacattcggtggggacaattttctttttctgtagtgggg

SEQ ID NO: 8133 - DNA, 262 bp, Diabrotica virgifera
  Clone ID: LIB3026-032-Q1-E1-D8
ccacgcgtcagctattttggttactaagttctttaacgatctcaatttggcgcttgggataggtggtaccttttggttgttcgcctgcttttgtattgctgccttagtgttcgttattttctttgttcctgagactaagggtaaaagttttcaagaaattcaaatttttttggataggtgatattagttgctagataaacagtacttataccttttttattaatgttttatattcaaattttaataaagttgttgtacctgg

SEQ ID NO: 8134 - DNA, 378 bp, Diabrotica virgifera
  Clone ID: LIB3026-032-Q1-E1-E1
gcgtccgcaaagaattaccagttggatcggaagagtgtttgcaaaataatattgtttgcccagcagttgatggcaagttcccagtatatgcagcacttccagattgtaccaaattctgtcaatgttcgaatggagcaccatacctttacaactgttcaggaggtttacacttcaatccttcactaaatgtttgtgattggccagaagatgctggttgtgaaagatcaatatagtaccgtcaaattcttcaaatattttggtattataaattttgaataagagaaaatgctgacaaaaaactgtttactgatatactcatactagttactgattttatattttgatccaaagagattataaaaataaattaatataagc

SEQ ID NO: 8135 - DNA, 306 bp, Diabrotica virgifera
  Clone ID: LIB3026-032-Q1-E1-E11
ccacccacgcgtcaatcagttggtcgcttagacagatcttcaaaaaccttttaaactactatgtatatacgatatatataatatataataaaccattccttttttttgaagtattttaaacagttaagtttgttgttaccctaattgtatccttgtcaagcagatattttttaaaatccttagaaaattattaggtttcagttatactaccttatttttttctcaaaatatattcatatttatgtttatatgtatataaaaaattattttttcttgtgagaaatcatcgcaataaaatttattgtt

SEQ ID NO: 8136 - DNA, 451 bp, Diabrotica virgifera
  Clone ID: LIB3026-032-Q1-E1-E12
gggccacgcacgcgaccgccacagcgtccgcttaaagaaattcaaaagaatacatggcaattaactgacagttaggtcgatatattaaagatattatactagctttaaaagttactgtctcttggttaggtgcgaaattaacggatgtttgtggaagtggccatactactattgtaacgcccttaagtatttattgaaagtagggcagcagaggtgctgtttaagtatgaaggtgccttaacattactttttcatttatattttcttgcaaagtcatttggcacctcaaattgttcgggtacttagttgatctaagtccaaaaattggtaaccatctgtttgagaaaaatatattgtaatattggttcatgttgataaaatgacattttttatcaaatcggtaatcagtattgatttgttttcttaagtgaaactttcaataaatttattc

SEQ ID NO: 8137 - DNA, 420 bp, Diabrotica virgifera
  Clone ID: LIB3026-032-Q1-E1-E3
gcgtccgaaaaaaatcattttcatcagatattaaatacgttgatatacctatacctgctggatgtgaggaagtgtttgtaagattttcaaattcggagtgtgctaaagaattttgtaataaagaatatcctggtgaaaagaccttgctggaaggagatgaagaacaaatgtattgggaaaagatacagaatgaccgaagcataaagttttcaaaaaatgttaaaaaacaaagaggaagagacaagttactgaagaaagcagagaaggaaagagcgaagcatattaaatttgatgaaggggaatgatgatttggcaatttttttgcatttctatagatgtaacagataaaagattcaatagatgtaaaaaatatttaacttgtttactctaatggtaattaataaatcaagatttacctgt

SEQ ID NO: 8138 - DNA, 400 bp, Diabrotica virgifera
  Clone ID: LIB3026-032-Q1-E1-E5
ccacgcgtcagcgaacgcgtgggggctaggagtgcattcaataacatggccaaactctttaaaagccacaaccttaatctgaagataaaaataaggctcctacgatgttatatcttcttaatattgtattacggagttgaatcctggacactcactgaagcaatggagaaaaaacttggaagtcttcgagatgtggctatacaggcgaatcctaaggatatcatggacggacaagataaccaacgagaccgtattacgaagaattgggaaagaaagagaggtgatgtataccattaaaaggagaacattagaatatctcggacacacagaataagaaactgcactaaatacagattactgaaggtaatccttcaagataaagtattcggaaagcaaggaa

SEQ ID NO: 8139 - DNA, 455 bp, Diabrotica virgifera
  Clone ID: LIB3026-032-Q1-E1-E6
ccacgcgtcagatattgcaaaatctattgaaccgattttaatgaaatttacagtgttgttttgccatataaagtttttctgtgttaaatatgaaggtcgtaggtgtaggataaatggttgaaaaacgtaaaatgcgaatacttgttttttgtggtttttttcgaaattattgctattttgcaacaagtgtgacaatttttggaattttcagttaatcgtatattgtaggaaatttaattacgcggcttttatgtcggtgcaacttttctcgaaaatgaatacttttaaggttataatcggaaaaccaagaaaaaaatcgaatttttccttcatttcttgagattttgattatttaaacaatgttccggacgtttttgagtgggaggataactcaaatattattatatgagttgttttcgggcaatttctgcaaaaaaatatgagtcacctctcaa

SEQ ID NO: 8140 - DNA, 215 bp, Diabrotica virgifera
  Clone ID: LIB3026-032-Q1-E1-E7
ccacgcgtcaaccaacgcgtccgattaaaagatctaacctaaaatgtactggaacatagaactaatagaataatttctaaataagtagcggactatattttcatacatataaatagtgattctttatttgcacataatattatgtaaatattttttattagactttttatatccttaaataaattggaatgttattaaataaatatatttacaat

SEQ ID NO: 8141 - DNA, 456 bp, Diabrotica virgifera
  Clone ID: LIB3026-032-Q1-E1-F1
gggtggcgcacgcgtccgataaaaatctttaaagccggtacagatttgttggttgtctttcaccaactatctcttcaccctcaaaaattcccaaattccataaacttttttacctttgcaacattctccgtctattccaccatatcccgttagcataacttaagcagatatatcatgttaatgaatactgaggtagtacctccttgtaaccgaatcatttagttacttgtaaccgttgacctgaagatgctctgcatactttagagagcgaaaccggtcgtcggaagttacaataaatgattgagagtacgtctgtcttttacttcattcaaaatatcataatttaaaaaagaaatcgacctgtttcgggattttccctagtgtcgtcggtttgcgaaataaagaatttattcctttcaatttgcacatactgtatatacgagtagttgcaaaatt

SEQ ID NO: 8142 - DNA, 262 bp, Diabrotica virgifera
  Clone ID: LIB3026-032-Q1-E1-F4
cgatcaaaatggcaaaacttacactcgttctcttggcagccgtctttgtagccgttttggctacccaagaagtcagcgccggtgctgtcaaaggtgcagaagctcctcgtgctgctggacttggagcagactgcgaatgtaacgcatgcagtaaagaatgcatatccgagagctccgactacattggaggtatttgttaccaaggccaatgtgtttgtgcctcccttggctaaactaaataatgtgataaagtttaattaat

SEQ ID NO: 8143 - DNA, 417 bp, Diabrotica virgifera
  Clone ID: LIB3026-032-Q1-E1-F5
agggaatccagcttggggtccacatgcctccacctggaatgcctcaggatcaacaacaacaaacagtgattgttactcacaccgtagcccaggttcctgttggccctactccaacatcgacaacatgtccatcatgtcatgctcagatagttacttcggtggagactgaaacaacaacaaagacacacttgttcgccttattgctgtgccttttcggatgctgtctttgctcttgcattccgtactgcgtggattcgtgccaagccacaacacattactgccccaattgtagagcatacattggcagattcgaaaattaagaagaacgaaatttcaaagatggcttaaacatcgacagataattctttatatataaacttataagaaaacccacatatattttactaatatgattgt

SEQ ID NO: 8144 - DNA, 423 bp, Diabrotica virgifera
  Clone ID: LIB3026-032-Q1-E1-F9
ttcgcggggccccccacgcgtccgcaggaaaagaccttgattatggcatggaagttttgagatgcgccaacaaagcaatgagaccaggagtacctgaattgggagttccacaacatgatcccttcgtcgcctttagtaagaacatatcatggcatggagacatcggtgttgctagcacctcaatcgacatcgacacattgagatggtatggtcttgccgactggaacgttactgctaagcaaatcaatgatgacgctgataatgtagcggtctttgactgggtcaatagatggcccgttttcacaatctccggcaactaccgagcaaccgttaaagaactgttccttacacagcattacaaaggaagcttcaaaatggtcatggagaaaccagtttggactggaaaaataagcgcaaattaaa

SEQ ID NO: 8145 - DNA, 433 bp, Diabrotica virgifera
  Clone ID: LIB3026-032-Q1-E1-G7
agtaaaaattaataattatatatttattattttcgaatttaaaagagctaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaatttattaaaattaagtaatgataataatattagtattaaaaaattgtaaatttagtaaaaataa

SEQ ID NO: 8146 - DNA, 443 bp, Diabrotica virgifera
  unsure (1)..(443): unsure at all n locations
  Clone ID: LIB3026-032-Q1-E1-H1
gcgtccgaaaaacaaataacaaaaatgtttgtccctaagatgctcttggtcttgggctttgcccttttagcctcagctggaaaagaccttgattatggcatggaagttttgagatgcgccaacaaagcaatgagaccaggagtacctgaattgggagttccacaacatgatcccttcgtcgcctttagtaagaacatatcatggcatggagacatcggtgttgctagcacctcaatcgacatcgacacattgagatggtatggtcttgccgactggaacgttactgctaagcaaatcaatgatgacgctgataatgtancggtctttgactgggtcaatagatggcccgttttcacaatctccggcaactaccgagcaaccgttaaagaactgttccttacacagcattacaaaggaagcttcaaaatggtcatggagaaacc

SEQ ID NO: 8147 - DNA, 255 bp, Diabrotica virgifera
  Clone ID: LIB3026-032-Q1-E1-H10
acgtacgcatccgcacacgcgtccgcttaaaaataaaattttattaaaatttaatttttatataaacattaggattaaaaattttcatattttaaaataagttattatttattttaatatataaatatttttaattattatatatttttaattaatatatatttataaatgatttaaatttaataatgatgatattgtaaatatagaaaaattgtatatgtagaataaatgtatacgttaacaatttgaactcgg

SEQ ID NO: 8148 - DNA, 441 bp, Diabrotica virgifera
  Clone ID: LIB3026-032-Q1-E1-H3
gtacaaagatcccgtggtaacagataacagaaaaaatgataagaaattccattagcgtttttaagagtgtgtttctatctattgtgcgacgaaaattaaaataaacaagttcgaaaaatgtaaaaatacaaggtcagacggtaaccttaaaggtaaccacttttataagatttccatggtcaaaatgtgataaaccacatcgtatggaggtattccgcagtttaattcgacgttaatatgaataggtgtgtttacttgaatagggtgttttgataattcgggcatgatccctatggatgtggaataataatggaagtatgtgtgaacgtccttaagcacgaacagccagaaaaactacacatccagttaacacattataagcaaaaatggaattgggactgtggtgtgtcctgtgttttgatggttctgtcgaagaagaag

SEQ ID NO: 8149 - DNA, 360 bp, Diabrotica virgifera
  Clone ID: LIB3026-033-Q1-E1-A10
aaattccggttttaactaatttatatgtgttgaaatgttattccattttaaatcaatctaagtttttatcagttaaattagatttatattatgtacatacatatggtataatttagatagtgtccataattatccaactattgagtcatttttagggatgagcttagcaatacaattttattagaatttgatttttaagtctcgattacgattaaaacttttcatagtttaaaaggtgttactatttaattttatatattattatttttaatttttacaaattttttattaaaatagcaatttaaattacttcaatttactaatgatgataatattattattaacaaattgtatgcttag

SEQ ID NO: 8150 - DNA, 356 bp, Diabrotica virgifera
  unsure (1)..(356): unsure at all n locations
  Clone ID: LIB3026-033-Q1-E1-A4
ggggggggggggggggggggggggggggggggnggggggggggggggggggggaggggggggggaaggggggggggggggggggggggggggggaggggggggggggggngggggggnggagggggggggggggggggggggggggggggggggggggggggggggggggggaggggagggggggggggggggggggggggggggggagggggggggggggggggggggggggggggggggggggggggggggaggggggggggggggggggggggggggngggggggggggggggggggggggggggggggggggggggggggggggggggggggggganggggggggggggggg

SEQ ID NO: 8151 - DNA, 287 bp, Diabrotica virgifera
  Clone ID: LIB3026-033-Q1-E1-A5
cgtccgggcagaaacagaagctggatatccacctttcaacacattacagccatctcattaggaatgaaacccgatttgatgtgggtagtaccgaatacattataggtgagtttctggcatttgctgatctgtacaattgtcctggcatactaatatcctcttttgaagtgactgccttgctacacggctactttggcaacccagcagatccagttgctcatcgagatatgtttttaccatttgttgaaaggaagctgagttttagcgacggaagaggtagcttcatc

SEQ ID NO: 8152 - DNA, 342 bp, Diabrotica virgifera
  Clone ID: LIB3026-033-Q1-E1-A9
gtaattttgtatgagggcgggcaagcagtaaaatccggtaataactagtttaaaactgtaaaaaggagagcccagaaaaaatcagttttagttttacatcagttacaatgagttctacaggtatttacagcggtttaaatgaaaattccagaaactccagtagggtcttaagaccgcctggcgggggccatacagatttatttggtgatgctgctaacgactccaaaccgtcacgaagagaccatggaagaaatgcttcttccattttagagggaacaaacagtccaactacatccccaacgactccaacaaagactgtagtagcacctccaccagtgccac

SEQ ID NO: 8153 - DNA, 422 bp, Diabrotica virgifera
  unsure (1)..(422): unsure at all n locations
  Clone ID: LIB3026-033-Q1-E1-B11
cgtccgaattaatttancatcanattttaaaaaatacatgtttaaaaattaactaaaaaagaaactacatatatctcaaaattatacaaggaattcaataatgttttctcaaaataaataaacaaattctagtgggaatatagaataaaaaaagaaaagacagatttactatattaatttcaaaacatatatagtgaaaattacaataataaactaccagtagacaagtagataanaatagacaataacaaagcactgaaatcaggctaaatagcatctaacatagcaatacaaacagttcaatagcaattaaagttacaagggctcgataaaacaaccaagataagatattacaagaaaaactaaatgtcaattgcacaaaaccttaatacatccagtatttacatatgaatctgaaatct

SEQ ID NO: 8154 - DNA, 266 bp, Diabrotica virgifera
  Clone ID: LIB3026-033-Q1-E1-B4
acgcgtccgccaacgcgtccggtttgctggtaatatctgcacagggacaaattcctgttgaaaggtgtccagatgtagaagtagttacaaatttcaatggaagtgcatatttgggtgactggtacgaacaagccagatacccaactttactggaagatcacggaagatgtgttgttaccaatattgcagtaggtgacgatagaactataaggagtcgtacccaatatatcaattcagagacaaatgagagacacgttctagaagga

SEQ ID NO: 8155 - DNA, 328 bp, Diabrotica virgifera
  Clone ID: LIB3026-033-Q1-E1-C10
acgcgtccgtattaattgtgtgtgtattggttataatgcctttttaaccttaatttgaacttaaataataaggtaaaatcaaaatccgtaaagggccaataaaattggatttttggggttaaatcaaccctttaatggatccagtaaattaattaacaagagaacaaatttaccctttaaaaccaaatttaaattaaaataattttccccaaatttaaaatttattttaagcttaattttatgaaattgtatacctttgaatactataagatgtaacttttaatttaacactattattttttttaacaatttccaattttaagggttt

SEQ ID NO: 8156 - DNA, 412 bp, Diabrotica virgifera
  Clone ID: LIB3026-033-Q1-E1-C11
ggggccagccacgcgtccggaagtattgcaagatttatatcagtttattgctgctaggagcttgccatctgttaactggtgacaatgaacactccgaagatctagagtacttcttgtacgaagacaaagacggcaatcttaaagtagagcgtctcctaaacagccgaccagaactcttgtcgtcgtctggatccgatgtaaagtactttttcttcagcaagtctaaccctggagatgaagaaggtgtggagattcacagcaacaacacagagaaattgaaaacgacatcatttacaacaaagagagaaactatttttaacgtgcatggatggaaggatagccataaagcaaatgttaattctcatgtcagagaatatatactcagggaccacgatgttaatatctttgtcgt

SEQ ID NO: 8157 - DNA, 408 bp, Diabrotica virgifera
  Clone ID: LIB3026-033-Q1-E1-C12
ggggccagccacgcgtccgcagacacgtgggatatttccaatcaacaagtaggtacttaataataatttttgatatttttaaaaatacatttaatcaaaatcttgaataaagtgtatatttttgacacacccgcataaaattaaaaaattagttcaatagttaaattttaggtttcagaccatgcaaaactttcgatgaggtatcattcctcacataataaagaaattttctctatagttccaactctttgagacatgccgtatatatttgctttattaaatgaaaaccactatttttatttttctttaatatttatatgggtcatgattttgtacatattttggatataatattgtatatgttatgtagattttgtacataaaaattaaataaaaattataattttt

SEQ ID NO: 8158 - DNA, 301 bp, Diabrotica virgifera
  Clone ID: LIB3026-033-Q1-E1-C2
acgcgtccggcagggttcgtcttaattttcagtccctgttcatattattcgtaacgggtgtttaaacttattagattattaaataactcacaggatggctagtcatcaaagccagggggttcaacaattgttagcagctgagaagcgtgcagcagacaaagttacagaggcccgaaaacgcagagcaaggaggctaaagcaggctaaagaagaagctcaagatgaaatcgaaaagtaccgtaaagaacgacaacgccagttccgtgaatttgaggctaagcatatgggctctagagaagat

SEQ ID NO: 8159 - DNA, 310 bp, Diabrotica virgifera
  Clone ID: LIB3026-033-Q1-E1-C4
gttatagtcctcgcgcgattttgattgtaacttcttcttcttgcagtaccgtctcctctcggaggttggctaccatcacagcaatcttaactttgttggctgttgattgtaacgaaaacatgtaaattattgaaattagtaatattaatagttatttatgtattaagagcgaaaagtgatagatacattattgcttgagagtaagagttaccgctcgacgcgtagcggagttactctaaagcaataatgtcactttgcgcttgtaatacatacaacattttttctacaatcacttaataaaatcaaacta

SEQ ID NO: 8160 - DNA, 346 bp, Diabrotica virgifera
  Clone ID: LIB3026-033-Q1-E1-C6
caaaactgtcaaaacatttgttgtaatttatttctcattatgtcatcaccatgacaacgcgaaagttaaggatatttgattatatgaaagtgtaccaaagaccgtgcgaaaaagtaaatcccgtttaaaatacattgttacttcacgcacactttaaatccttcacagactgctatctgtaatgacagttttcacagactaaaaacttatacataatatgacttagagcagataaagatttttttgtactctctgagagttggatattaatatgtgaaaagttttatgttcatttttgacagaggttctgagaaaagaattcttgaaaaatatgcttattttggtg

SEQ ID NO: 8161 - DNA, 345 bp, Diabrotica virgifera
  Clone ID: LIB3026-033-Q1-E1-C7
ccacgcgtacggaacccggtacaagaactatcgtccggtacaagctcccgtaaagtaagaataaaatcccattacttagtgttaatcccattatttagtagtacatcaatctatactacaaattaggtcccctttacttttaaagtgaaatgcaaatcaataattcctgcccaagaaaaatgacttcacatgtgactatatgcagtatttaaacaaatgcaaaagatacatgtgctctttttttaaatatttactgaatttagtaagccccacaaaaatgacatttagtattgtaataaaaaaagaaactactacagttagtgtaggacaaagtctcctaagcta

SEQ ID NO: 8162 - DNA, 328 bp, Diabrotica virgifera
  Clone ID: LIB3026-033-Q1-E1-D1
cacgcgtccgatacgttcaattgtgtgcgtacttgcagtccattttgtaagttccgttagtctccaaaagggtacacttgatatcatagagggcaattgcaccagtccaaatccaaaacaggcagtattgaaagattatgtccacaagactagcattccttttgtcaaaagagacgaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggc

SEQ ID NO: 8163 - DNA, 335 bp, Diabrotica virgifera
  Clone ID: LIB3026-033-Q1-E1-D10
tccgcccacgcgtccgaaactctcttgggtttacaaaaagttggcgtcggaataaattatgaacaggacgctgcgaagagagcagagaacgttgaaaaatcgaaacaagttctaccagtttattttggaaaactagaagaacatgctaagaaacacaatggttacatagtttttgacaggatgtcatgggctgatattttaatcgtttgcgtgtatgaatttttagtcccttgtgtaggtaaagaagcagtatctgcttatcccagtttacaacaagttttgaagaatgttctagcagcaaaaagttttaataaatatattaataaaacgccttc

SEQ ID NO: 8164 - DNA, 438 bp, Diabrotica virgifera
  Clone ID: LIB3026-033-Q1-E1-D11
gggtccagccacgcgtccgcacacacgtccgaattatatatttattattttcgaatttaaaagagctaaaaattaaaattttatggtaaataaaattaaaaaattttggaagaaatggtatccgtttaaataaaaccaattttttaagaaaataaattaaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttacatttagtaatgatgataatattagtatttaaaaattgtatatttagtaaaaat

SEQ ID NO: 8165 - DNA, 345 bp, Diabrotica virgifera
  Clone ID: LIB3026-033-Q1-E1-D4
acgcgtccgatataaaagagctaaagaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttagataaaaattaggattaaaaattttcatattttaaaatatgttattatttatttttatatattattagttttattttttataaattttttattaaaatataaatttaaatta

SEQ ID NO: 8166 - DNA, 406 bp, Diabrotica virgifera
  unsure (1)..(406): unsure at all n locations
  Clone ID: LIB3026-033-Q1-E1-D9
gcgtccgcacacacgtccgcccacgcgtccgaaactctcttggatttacanaaagttggcgtccgaataaagtttgaacaagaacccgctaagaaagcagagaacgttgaaaaatcgaaacaagttctaactggttattttggaaaactagaagaacatgctaagaaacacaatggttacatagtttttgacaggatgtcatgggctgatattttattcgtttgcgtgtatgaatttttagtcccttgtgtaggtaaagaagcagtatctgcttaccccagtttacaacaagttttgaagaatgttctagcagcaaaaggtattaataaatatattaaaaataggccagcagtaaaagggttatgatttaaaacaagatctttaagaattttttatatatttttta

SEQ ID NO: 8167 - DNA, 159 bp, Diabrotica virgifera
  Clone ID: LIB3026-033-Q1-E1-E3
tctaccagaatgactaacaatccaagaatgcatttcgaccaagtccaatgccctgctgaaatcgttgccagatctggttgcagtctttaaataataatataatataattatttgttttaaaacaattatgttttacttaagtatatactcaatttaaaa

SEQ ID NO: 8168 - DNA, 371 bp, Diabrotica virgifera
  unsure (1)..(371): unsure at all n locations
  Clone ID: LIB3026-033-Q1-E1-F12
cggggccagncacgcgtccggatggataaagcattaaagacactctataccaactcatcgtttgtggaagaccctcttggatatataaaatacaacagcgatgaagtttttggacgatcgacagcacgtcaagcagaagctgcatctcgatttgttcctgtgtacatgtatcaattttcttggtatgacaaaagtagtccccttccaggtgttaaacatgcagccgatttatattacatgtggaatgtatcattcggcaccactacccacaacgatgctcttcggaaacctatacttaaatggtggacaaatttcatcaagtatcaaaatcctactccagtaaaagatgaagatctacaaaatgtcatttg

SEQ ID NO: 8169 - DNA, 404 bp, Diabrotica virgifera
  Clone ID: LIB3026-033-Q1-E1-G12
aaaacagaaagaaaagatatctcaagttaaacaagccaaacagcgaacattacaatcaagggaaatcaaacgaaaaataaaagcttctatcataaaagttcctgataatataaatgatgattttctggataaaactgtagaaaatttagttattacacaaaccagtgataatattgacgaatcaaaacacaaaaaacgcaaattaggaccagaatcactggaaggatttacggttctaggtgcagaaaatgttgcaaataaagttaaagtaaaaagagttcttccatcatggttatcaaatccaacagttatatcagtaaacttacaagacctacaaaccaaattttcggatcaaaaacatttagacaagggaattcgtaaattacccaaagcaaataatatac

SEQ ID NO: 8170 - DNA, 200 bp, Diabrotica virgifera
  Clone ID: LIB3026-033-Q1-E1-G7
cacgcgtacggaacgcgtccgtatttatttgagaaataataaaatattttttagtaaaagtaaggaagaattttatttaatgagggttaattagtattgtgagagaatatttgatttttatgagagaaaaatttattttttgtaccttgtgtatcagggattattaattgataattatagatgttattattttcgaattt

SEQ ID NO: 8171 - DNA, 324 bp, Diabrotica virgifera
  Clone ID: LIB3026-033-Q1-E1-H4
taaagaaataagaagtggacctgtggacgagtggtggatcgaatggatatcgtatcgatatctctatctcaaaaaatttgaagtttatcatacacataaaaaataaacaaatattgaatattttcgtaaatattgcatagaaaaacaaatacattatcaaaaatttatagaaccgtctgcaaagcagctgtagcctttcgtagtttggctcttatatcaaacaatccaaagatgtcaaatcccgagaactacaaagaagcctcctccatttacgatttcagtgcaaaagatatcaaaggtgaagtggtctctttagaaaaatac

SEQ ID NO: 8172 - DNA, 318 bp, Diabrotica virgifera
  Clone ID: LIB3026-033-Q1-E1-H5
aaacctttcactccatttatgatgataaactgcactaaaaatcttgcagttcctctatattgtctgaaatatttttctacataaattttgaacagtagtggggagggaatacaaccttgtgtgacatccataacataccattttcagatcttaatcatcgattgttagtggacgtttttggagcagaatgtcagtcatcgagaaataggctttgttgcacgtcattgttcttttttgaatctgaagtttttactgcttcgacatcatcctttggtgcctatttccccttgtccgggtttgtgtttagggttttgcctt

SEQ ID NO: 8173 - DNA, 312 bp, Diabrotica virgifera
  Clone ID: LIB3026-033-Q1-E1-H7
ttcgcggggccacccacgcgtacgcgaacgcgtgggcaacccccccagaacgagagttcgcaacggtacaccgtacagaagaaggaggccaaactatgctagactccaaaattcatcaacacagtgacgcacttgatgtgccatagatttctaatgtaacttgattgtaattaatgtacagtatataagataagaaaatagtagcttatataaagctttaaacgacttgtgattcctatatcgctgtatgtaagccgctgttgagagtatagatatatttaacaaattttttagttgtcatttcgcgagaaa

SEQ ID NO: 8174 - DNA, 333 bp, Diabrotica virgifera
  Clone ID: LIB3026-034-Q1-E1-A5
cccacgcgtccgaaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaat

SEQ ID NO: 8175 - DNA, 218 bp, Diabrotica virgifera
  Clone ID: LIB3026-034-Q1-E1-A7
cccacgcgtccgcccacgcgtccgatgaaccatctgctcatcgccttctcagttttcaacggcggctcattggctcaacaatatccataaccaattccaattgttaactatgaaaacgaaggcgtaaacgctgacgggtcttataattggcgcctccaaaccggaaacggtattatcgcgcaagaacaaaggcagatcaaaaacatcgccaatgaaaa

SEQ ID NO: 8176 - DNA, 120 bp, Diabrotica virgifera
  Clone ID: LIB3026-034-Q1-E1-A9
actgtagcaaatgcctgcaaaaaagtccatgaagaaatccaaagggacaaaaaacacagatttgcaattttccacatcaaaggtgggaaacaaattgatgtttaacacatatgagaaaaa

SEQ ID NO: 8177 - DNA, 393 bp, Diabrotica virgifera
  Clone ID: LIB3026-034-Q1-E1-B11
gcagttcttgctattgaatcaatagggaaggaactccatttcagtagccgccgtttttgtgtaagggttatgtgttccatgaccaaataattttttatcgcttgattcagttttttaatgccattatattgtcgttgaatcgagttgattcactacattacttcgtgcacgaagtttgattagacacctgaatagtatttagaagttttcgtattttaccataaagtaatgatactcgatataaaatttcaagctaacgatttaaagagagatatttgattgtagtagtaacaaaagtagtgattttaagttcacaatatgtatgtgtcaaaatgttcgatatttttataaggttagtattagttttgtaaataattaataatgacactgaaa

SEQ ID NO: 8178 - DNA, 293 bp, Diabrotica virgifera
  Clone ID: LIB3026-034-Q1-E1-B7
ccggctcgaccacacgtcacgctcaggaatgctggaatgatgggtaggatgagagtgtaactgtagtaacttaatttaggtataatacaggaattcggtaacatttttttcatttgtttaggagacgcaagtcccctagtgagatttaggaaatcacgcctgcccactgataaaattgaatggacgcagaaagttgaccgagctaaggtaggagaatcattaatatttttagtgacagctagattaataggttggttaaaaaatatacggtccatatttaatgtatagagaat

SEQ ID NO: 8179 - DNA, 399 bp, Diabrotica virgifera
  Clone ID: LIB3026-034-Q1-E1-C10
ctaagtttagatttcaagatgaagctaatactttttggtattgttgtattgttatattttatatactgtactgaagagggtagtgcactaaactgctatcagtgccaagcgaaggttggaaatgggtctgactgcgaaagtgggaaaagtgattctaatactacttgccagtcttctccagacagcaatgagacacttgcttgtttctctatagtagtaaatggcttttttataagaggttgcgacaaaactactttatgcaatgatgaaccaccacctggatatgatataaaatggtgtaaaagttgtactactgacttatgtaacactcacacttcttcttcctctattattacaccagctttattcactccaatcattatttttaccgctgtacta

SEQ ID NO: 8180 - DNA, 353 bp, Diabrotica virgifera
  Clone ID: LIB3026-034-Q1-E1-C5
gttgtcttacttttgggccttgcccttttcgcctcagctggtcaagatcttgacaagggcatggaaattgtgaaatgcgcccagcgagtaatgagcgtaggagtacctgaattaggagttccaccacatgctcccttcgtcgctattagaaacgtatcatggactggatcaatcggtgttgcaagcacccatatcgaactcaataccaataaatggtatggtcttgccgactgggatatctcagctaagcaaatcaatgatgactctgattacgaggctgtctttgactacaccacatactggcccagttttagaatcgtcggcaactacgaagcaaccgttaaagagctttt

SEQ ID NO: 8181 - DNA, 355 bp, Diabrotica virgifera
  Clone ID: LIB3026-034-Q1-E1-C8
ataaaaaataaagctacaggtcttaaaacaattccaaccgttgatcgtgtatatttcagtgtatcctattgtgaaaagtcttgtcctgtgtttgtttccagccagtggagtcttggaagagcaatcgatgctatagctgaagaaatgaaattgcaaaacaacaataacaaagcaaatgagaagaaattgagacttttcacaaaagaggatagtgttagtttatcaactgatatgtctgttacgataaaaaagcttttgggagataaaattcttattgatggagatactctacgcattaaatatgtcgattcttaattttaaattatatttgtttgtattaaaatgatgcacattg

SEQ ID NO: 8182 - DNA, 150 bp, Diabrotica virgifera
  Clone ID: LIB3026-034-Q1-E1-D4
atttttaaatcttttgagaaatgagtaattccaataaataaagttatctacctcgttttgaaaaaaaaatagtaataaaaaaaaaatcacacaagacaaatgaaaaaaaaagaaagcaacacagtaaatgggccgaaccacaggggggat

SEQ ID NO: 8183 - DNA, 379 bp, Diabrotica virgifera
  Clone ID: LIB3026-034-Q1-E1-D5
cgatttctttctaacgcattaattgcatgtgacagaaaaaaacgcacgtcggtgattacatttcgtcggtgaaatttataacatttattctagttgtcaatagatggcgctataatcgaaaaaaatatttacgaattatataatatatctacgaatataaccggtacaatttataggactatacaattcaaggaaaataccatttaataaatgcaataaacacaattgatttgattataggccaatttgcaaataatgtgtgagaagtgtcagatttatctaaagtgtcatgtcactaaagtgtatattatcagggatttaccttttgtactatcatttgtgacgcactgaaaaatgctcatgaaaagaattatagttg

SEQ ID NO: 8184 - DNA, 376 bp, Diabrotica virgifera
  Clone ID: LIB3026-034-Q1-E1-D6
cgttaacgagcttttccttacacagcactacaaaggaacctacaacataaccatgattaaaccaaaatggactggaagaatcagcgcacaaaaagtccccactgtcttaacacctaagcccattgtagacagttttaccgtcgactggcacgttgcagatgtaaaatgcaaaatcactggtatgggaataattggagacacctatgctctcgctattcaagaaggcattgaaacagccctcaaccattgtcttatcggaaatgccgtcggagacttccttaaaatgagattcatcactgtctggtatcccactggcaaaatctggcaaatgatggactggtgcaacggcggctccaccgacgccccaacaactgct

SEQ ID NO: 8185 - DNA, 378 bp, Diabrotica virgifera
  Clone ID: LIB3026-034-Q1-E1-D9
gtgacgtaaagtcaaaaatataagtctccccaccaccgttggacaagacaaccgtaataaagtctaataaccgtgggtctacaataattaaaaaagttgtcagatcactgtattatttaaagtccggaacagagccaattttttttggcttattttcctggagtaaatgtgtccaggtttacatacgtatttacgatagaaattattatttcgacatactttgtacaaaatattaagactttaaaatttgtttttatcgctagtattttaatttttattattgtattattaataactattgatttgttattgataagttacttttacttttagtatatacactgttattttaataaaggatgatatattttcatttcg

SEQ ID NO: 8186 - DNA, 433 bp, Diabrotica virgifera
  Clone ID: LIB3026-034-Q1-E1-E1
tcccgggcccacgaccgcattaatcggcggccgctctttttgatgtcaaacttacagaaaaattttatttaatgacagttaattactaatgtgagagaaaattttatttttagaacagaaaaatttaatttttggaccctgtgtatcaaggattattaattaataattacatatttaataatttccaatttaaaagagctaaaaaattaaaaattttattgtgaaataaatattttaaaaaatttttttgtaatgaaatgttattcctttttaaatatatctaattttttaagaaataaattaaatttatttattaacaatatatttataattaaatatttttatattattaacattaaatatttttagggatgagcctaaaaataaaattttattaaaatttaaatttttaaaaaaaaattagggttaaaaa

SEQ ID NO: 8187 - DNA, 395 bp, Diabrotica virgifera
  Clone ID: LIB3026-034-Q1-E1-E2
aaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttaaaaataaaattttattaaaatttaatttttaaataaaaattaggattaaaaattttcatattttaaaatatgttattatttatttttatatattattatttttattttttataaattttttattaaaatataaatttaaattatttaaatttagtaatgatgataatattagtattaaaaaattgtatatttagtaaaaatatataggtttaata

SEQ ID NO: 8188 - DNA, 322 bp, Diabrotica virgifera
  Clone ID: LIB3026-034-Q1-E1-E6
tcatcagcccacgcgtgcgggagaggatcaatccttatctgctcatgcatacaatatcaaattgcttgaagaatgtcattcagattcagatcacgggccgtcgatatcagcagtctttaacgatttctttactgccaattaatcctgatgtccaccttgcagccacatcggacatttctttcttgggcatatggacattgaggcacacaatcatcacgtgtcgtcctcattacacattatgcatgacaaacgtcacgcgccctgtgcccgcgctgtagacgctgcagttattgagagaccttggacactaaaaggggaaatt

SEQ ID NO: 8189 - DNA, 420 bp, Diabrotica virgifera
  Clone ID: LIB3026-034-Q1-E1-F1
atttattttaaaataataaaatattttttagtaaaagtaaagaaaaattttatttaatgatagttaattagtattgtgagagaatattttatttttataaaagaaaaatttaatttttgtaccctgtgtatcacggagtattaaattataattatataattaataattttcaattttaaaagagctaaaaaattaaaattttattgggaaaaaaaaaattttaaaaaatttttttgtgaagaaagtgttacccgttttaaaatatcccaatttttttaagaaataatttaattttatttattaacaatatatttaaaattaaatatttttagaataataatattaaatatttttagggaagcgcttaaaaataaaattttaataaaatttaatttttaaaaaaaaaattggggttaaaat

SEQ ID NO: 8190 - DNA, 340 bp, Diabrotica virgifera
  Clone ID: LIB3026-034-Q1-E1-F10
gttttagctattttagcttgcgtcggtttaaccgtcagcgctcccccaaagaacgacgtcctgtgtgatggctgcgtagcattgacacaagtgatccaggaccacttagaacaagacttgccattggacgaacttgaagaaatagtaagggaagggtgcagtgcattaccagatccacttgcagatatatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaac

SEQ ID NO: 8191 - DNA, 366 bp, Diabrotica virgifera
  Clone ID: LIB3026-034-Q1-E1-F5
cccacgcgtccgcttttaacttcgtaacctgcaaaggtatcgtcagacaaattgatacagatattgatgaaaaagaacttcttcggtgttgcgatacaggaaatgacattgaaattttacatataaaaagattaaatagaagagtaattaaagatggagtaacttcttatgaacccacaggtacgacactatttacatttcgaggcgttcttatgcccaaaactgtttttttatggcataccaagactagtggacacatatattgccccagtgacacaatgctataactgtcttagatttggccacacaaaaacaaactgtaaagggaaagtaaagaggagttttaaagataaacaaattgcgctg

SEQ ID NO: 8192 - DNA, 420 bp, Diabrotica virgifera
  Clone ID: LIB3026-034-Q1-E1-F7
cacacatgcatcaacctgttacaagggtcaaatatgtgacagatgtgagttagataattgtgcttccattttaaaactaaccgatgaaacgttcgatccgcccttttgtatattcagaataaccaatgtgatattagatttaatctatcaatcctatttcattgcgtatatattgacttctacacaagtattgtatgttttgtttaatatcattgtgttttagaccaatttacagttgtaggtatctaaatagttttttacattgttcgattttactaaaaatacgctaggccgttattttttggctttagtatttatagtaaaaatgccaaccgagaatttgtatttatttttaatacttgtactactaagagaaatttttatttgtaaaaaatttttggtatgtcaactaaaacctaa

SEQ ID NO: 8193 - DNA, 289 bp, Diabrotica virgifera
  Clone ID: LIB3026-034-Q1-E1-F8
aaaaggggaagtcactaagaaagagggtgaagaaaaaccaaaagaaaaactaatttaaaggttcagaaaacattaactttaagtaaacgaaacttttttgacacattttcttggcctcgataatggttttaaattggagaccacaatttttggaaagaattggaaaccgtaaatccaaaccaatccatttttggtgaaaactgggccaaaggtaaaggatattccataggaattacataattatccaaatatgtgatgtttaatttaaaataaagggaaatttttctgt

SEQ ID NO: 8194 - DNA, 420 bp, Diabrotica virgifera
  Clone ID: LIB3026-034-Q1-E1-F9
gggattattaattaataattatatatttattattttcgaatttaaaagagctaaaaaattaaaatttttaatgtaaaaataatatttaaaaaaatttttttgtaatgaaaggtaatccgttttaaaaaaaaccaaattttttaagaaataaattaaatttatttattaccaatatatttaaaattaaaaattttaaaataattaaaattaaaaattttaagggatgaccttaaaattaaaattttattaaaatttaattttaaaataaaaattaggattaaaaatttacatattttaaaatatgttaatatatatttatataaattaatatttatattttatataaattttttattaaaatataaatttaaattatttaaatttagtaatgatgataatattagtattaaaaaattgtat

SEQ ID NO: 8195 - DNA, 420 bp, Diabrotica virgifera
  Clone ID: LIB3026-034-Q1-E1-G12
ggaaaatcagaatactaacaaggttaacaagctaagtttgactggaaaccttctcggaagaatactgttgctgatcttaagaaacgacgatttcgaaaaggcctgcatcatcatggataaattggataaggatcatcaaaccatcgctggcgtaccggacattgaggctttagaatgctttgttgatagctgtattgagagaaaagcgccatctagagccatcgcatgcatccagtattgtgctgacagcgggttccaggaagctggtatatttgctgctaagcttaacgagaaactgacacttgatgaatcgcacctgaacagtctatcaaggatcgtaggtgatgtgaagctagcaaaagtctcagaccaaagttgaagatgtattttatatattgatcagttgattttctgactttg

SEQ ID NO: 8196 - DNA, 419 bp, Diabrotica virgifera
  Clone ID: LIB3026-034-Q1-E1-G4
ggtcacggaaatcccgggactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatccaagaaaggaggaccctacattacgatgttgaaatttacgccagggcaccaaataataatattaaataataaatacat

SEQ ID NO: 8197 - DNA, 395 bp, Diabrotica virgifera
  Clone ID: LIB3026-034-Q1-E1-G6
tccaagcgtccggaaggcattctatatgacaagtggacaaatctttaaccggttgaacccccaccacttctgtgacgatcaaacatatctttcaccaacggacaatcttatgcttctgtaccttgtgtatgagggattactggctgttaccactatcattcataatggccaccatggatgtttcaccctcatatgtgtgcaatcgcatccccggatgactcaaatttgtccatgtgtagcaaaatgttaatcctttcgcagcccaccgtgttatggagcacacaagagccatttacatacatatgcgcacaattgacaattacgccggcctatataccaaattttacatatttttagggatgagctggcggccgccctttaagatccaatcatat

SEQ ID NO: 8198 - DNA, 273 bp, Diabrotica virgifera
  Clone ID: LIB3026-034-Q1-E1-G7
tttaaaattcagatttgaattctttagttcaagtaatgaagactttaataggatgaaagttcagtactattgtgagacaaaaattggtttacaaaaggaattcggtaacattttgtacatcggcttacaaggatcatgacttattgcctaaaaaataaatactcgccagctcacagattcaactgaatcaccactgtaattgtaccatgcgaatgtaacataatcattacgtcttgaactgatacccggaatgaacgacaccctgctccggag

SEQ ID NO: 8199 - DNA, 244 bp, Diabrotica virgifera
  Clone ID: LIB3026-034-Q1-E1-H1
cacaaagcacatggtctcctactgattatgtcctaagcgtgcaccacatttaatacataaaataacgatagactcggaaaataaaattaaataaataagtacgcgataaattataaaattaaataaaaataatttaaattaaaataaaataaaaaataaaataaaataaaaataaaaataaaaaggcagtcagcgtggtttgggtgtaaaaggtcctcccctcgctgactgccttccacagccg

SEQ ID NO: 8200 - DNA, 385 bp, Diabrotica virgifera
  unsure (1)..(385): unsure at all n locations
  Clone ID: LIB3026-034-Q1-E1-H2
cagatttatcaatagcgaaaatgtttaaagttacgtcacttgtactgatcatctcaattcttgctccttttgcaattgcaggacaggattcagctgttgaatggagaccttataatggagtaccagatgaccatgcaataataattcaagttcaaactgaatatagcccagctgtttatattggcctagcacacgtgattgataatgcagcgcagtctgaagcttatcttcctgtaaatatagttgaaggcttcaactatgcaaacgtaactttaaatgataaaaactatatggctgacaatcttcagattctatgtttcaaaaaccctgatgcattgggatggcaatatacaaaagcagcaaactttgatgacttantgaatga

SEQ ID NO: 8201 - DNA, 363 bp, Diabrotica virgifera
  Clone ID: LIB3026-034-Q1-E1-H6
agggattcggcagcatttttttcacctgtttattaacatcatgtctttttgcaccaaatattaagtcccgcctgcccactgattcattagaatggacgcggaatattgaccgtgccacagtaacataatcattactttgtttattgaaagctgggatgaaaggttggatgaccaaaacaactgtcattacataagctagaaaaaagtctatttatatagtcatatagcttaaatttgttttaaatgacgagaaaaaccctatcgaagttttataaattcaataataagtttatttagtaataaattaatttataaaataaattaattaatttggggtgataattcaataaatttatctttttt

SEQ ID NO: 8202 - DNA, 417 bp, Diabrotica virgifera
  Clone ID: LIB3026-035-Q1-E1-A10
aaaaaattaaaatttttattgtaaaataaatattttaaataatttttttgtaatgaaatgttattcgtttttaaatatatctaattttttaagaaataaattaaatttatttattaacaatatatttataattaaatatttttatattattaatattaaatatttttagggatgagcttagaaataaaattttattaaaatttaatttttaaataaaaattaggattaaaaattttcatattttaaaatatgttattatttatttttagatattattatttttattttttataaattttttagtaaaatataagatttaaattatttaaatttagtaatgatgataatattagtattaaaaaattgtatatttagtaaaaatatataggtttaataaaggaattcggcaacattttt

SEQ ID NO: 8203 - DNA, 328 bp, Diabrotica virgifera
  unsure (1)..(328): unsure at all n locations
  Clone ID: LIB3026-035-Q1-E1-A3
ggtcaagaattaccgggattcattaaacggatcggtgcaggtcgaccttatattgtatcttagactattgcatattatttgtagatgtcctattagattttttaatataaaagtatttgtgctagtatcatctaacgtacgaaattttttatctttatattattcattccatatttattagatacattcttcagtagattatttttgcttganatttttantttttcaaatattatttttgttaacaaagtcgtgtacttcatttttaatttaagaacgtgttaaagagatttttaataattaatatttatataaaccatcgcaacat

SEQ ID NO: 8204 - DNA, 423 bp, Diabrotica virgifera
  Clone ID: LIB3026-035-Q1-E1-A6
aagctccggagatacctacacctataccgtcagcatgcctgtaaaaaaaaattatccaagggtaacagtagatattgagctacatcaaattgacgaaaatgacaaagacgtaatttgtgcattggtaccagctaagattgtaacttgagccagaaaattcccatagttccacaaactgaataacgatacaaaatcaggataactctctacagctagtctaaaatccttttaaagttttaatgctaacacagttcaatagtttttaattttcacacatttttgtattatatatattttaaataagtagatcaataatatatatagatatttaagacttaaaattaagaataactggttgatacattacaggtaatatttaagttataatatgtagaaatagtaatttttaatgaaagattaata

SEQ ID NO: 8205 - DNA, 425 bp, Diabrotica virgifera
  Clone ID: LIB3026-035-Q1-E1-A9
cccacgcgtccgcccacgcgtccgcaccgttgagttcggctttctatccaaacaaaaatcgtgagcaggcttttgaatttggaagaaaattaaatagttcctttgcttctagtaaatctagtgatttattgaaactgttacaagaagcaccattgtcagatatagtgactcagcaggcattgtcacccactgcatgtattccaactatggaagaagaatttaacgacaaagcttttgttagtggaccaatgcatagagccattctcaatggtgaattcaactttgttcctgtcttaataggcatcaattccgaggaatacctgttgtttgtggatgcagacagtgacgattttaaagaaaaatgcaaatattttgatgacaatccagaacaaatggtctctgcatctttcaatgtagctgaagaa

SEQ ID NO: 8206 - DNA, 435 bp, Diabrotica virgifera
  Clone ID: LIB3026-035-Q1-E1-B8
cccacgcgtccgcccacgcgtccgcccaatcagaaaaagaacacgatgctgacaaagaagaaaatcttactaagcaaaacaataaaaatgcaggagaaaatgaaaatggggaaagtaaaaaaaatagtgtagacgttgttgagagtctaagtaataactatgataatattaaatctatagatacagaagacaatgacaacgacttttcaggtttcgatctaaatactgaaaaagagaagaaaaatagtggaagtaacaattctgaccaaataattactaatgatattaatataaccaacgataataaaaatgtagaagaaaaagacaacggggagtgtcatataagtgaggaagaatgtattaatcataataatgtcaatgataataattattctttcagtacagaccaaaatattgaaagagatagtgagaata

SEQ ID NO: 8207 - DNA, 425 bp, Diabrotica virgifera
  Clone ID: LIB3026-035-Q1-E1-C12
cccacgcgtctgcccacgcgtccggaacaatttgatattttctgaagatattaatatattaaaaacaatttacaaacatatcaaaaactgtaaatatagattgtagcaataaaatttaccctctatttaagaaattttgttaaaacaaagcaggcatgtttgttaaaacaaaacaaacatgtttgttttgttgttattttgttttaaaccgtgtagatttaagtaattattgtatattataattgaaaaaaaaataagaaaagcaaaaaaaaataaaaaaagcaaaaaaacaaaaaaaaaaagaaaaaaaaaactaaaaagatgtaaacctccgcgaggttgaatcgggtttacgtcttagcgtagtaaaaaaaaacaatttacaaaaaataacaataaaaaaattaaaaaaaaacaaattaaca

SEQ ID NO: 8208 - DNA, 383 bp, Diabrotica virgifera
  Clone ID: LIB3026-035-Q1-E1-C3
cccacgcgtccgcccacgcgtccgaccaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaacctgttgctgaaattacagttggtggagttggtcacaatttcgtaaatgtacatttgacatctaagaaaggaggacccctacatta

SEQ ID NO: 8209 - DNA, 408 bp, Diabrotica virgifera
  Clone ID: LIB3026-035-Q1-E1-C4
gcatttcaaacgtggttaattataggtgttaaattgattgaaaattgaaaatggctgcctactactgggtggattgtcatgcaaggggcgcactaccatctacagcacttcgaggaggtgtggatatagatggagctgaaatatttgttggtaggtcttaccacgaaggcgactggcttccagctaaagttattccaagcaaggatgttgcttatgtagcttataacggaggcgaacacgctaaagatcagtttcaggttctttgtgaacaacgctttgattgggtaccttcaggcaatggtcacgttccctttggtgctgtagaaggaggaagaacttcagatggagaaccactgtacattggcagggtgtatcatttaggatctcacaccgttggaaaggtacatc

SEQ ID NO: 8210 - DNA, 317 bp, Diabrotica virgifera
  Clone ID: LIB3026-035-Q1-E1-C7
cacaaacctctcattacacatcagttagactatcccaaggtctaagctgttgaaaaggttgattgcacataaattgctgttttggaagccaaagttcaaggacagtctggataatgcggggctttaattacaacggattccaccaaaggtcaatcctcaaccaacaaaatccacctgatccccccaattaaccagaaatggtatacacggagatagtgaaccatagttttgacagaggtttgataaaacataccttcttttaaattgagcaccacgggctttcaccacaagaacactacacctatacaggcgtatat

SEQ ID NO: 8211 - DNA, 423 bp, Diabrotica virgifera
  Clone ID: LIB3026-035-Q1-E1-C9
caatgaattcatgacgcaccagtaatttccttttaactgacccaaacagccaatggcaatcaaggagaactactgattggtggatcagatccaagtaattacagaggagacttcaccaacacatgagtaccgtgtaacagggatggcaaactaagctacaaagtgttaccgtatgcaaacatagtttatctaagaatggatgtcgatcagtgatagatactggtacttctcacatctacggaccatacgatgaagtcgaagctaacaagacgcaattggtgccatctaagactacgatcttggaattcacaccaatgactgcgatgccgatttgacaaagcttccaaaagttacatttacggacggacgcaagaattttgacatatcaccatcagcctacgtcatcagagattcgagtaattg

SEQ ID NO: 8212 - DNA, 415 bp, Diabrotica virgifera
  Clone ID: LIB3026-035-Q1-E1-D1
cccacgcgtccggaaatattttatattattatttacccgcccagggggtagtaagttacactgcactttcaataaatgtaatgaacccatcgttggttttcagaatattttccaaaagagatgttactaatatactattgggacaaacgctgttaggttctggtctatatttatataaccgaccacatttaaaagctttacccacaaaagagaaaattctatacagctcatttggtgctgtcactttctctttaggatccgttttggtgtgggctatcttcagaagtgttgtcccccaaaatgtagctttaggaacagtatgcggtattggatccggtattgcactgattaaaattgcaagaagttatgtagaacatgtagactctcttgtagcagaaaaagcttaagtgatttt

SEQ ID NO: 8213 - DNA, 386 bp, Diabrotica virgifera
  Clone ID: LIB3026-035-Q1-E1-D7
cccacgcgtccgattttatacaactcatcagtgttcactggttgtaaattacattttattctaattttttaacctacaactctacattccttgttaatttaaaataatcgtcaaattaacatagaatttgcaagaaacatgtacaatgggcatttaagatctgctgccgtttgatatagaattcccttagtgttaattttattgatttgattttgtaaactgtagatgaataattattgtagatgatagtttgaatgtatagattttattgtacctatgtaatttaataagagaggataaaacgatctatatgttgtaaacaattgatttaagtaagtttggtaaatgtattgtccaaagtatatcttaaaatttggtgtaatttt

SEQ ID NO: 8214 - DNA, 78 bp, Diabrotica virgifera
  Clone ID: LIB3026-035-Q1-E1-D8
cccacgcgtccgcccacgcgtccgagttctagatcgcgagcggccccctttttttttttttttttaaggttcttaatt

SEQ ID NO: 8215 - DNA, 211 bp, Diabrotica virgifera
  Clone ID: LIB3026-035-Q1-E1-E2
aaagccaaaaatgaagctaacaggtgtatgttttttaatcgtggctttttgcgctatcaacgcattagcaagaccttccgattcggatgatccattaccagatggacaaactaatgcaccatctgttccaacatcagattctccacctgacacaattaactgattcatcaaccacggaacctaaaaattttccaactttacttaccattga

SEQ ID NO: 8216 - DNA, 187 bp, Diabrotica virgifera
  Clone ID: LIB3026-035-Q1-E1-E4
agtccacgcgtccgcccacgcgtccgatactaatattcgtaattttcataacgggtttaatcaacactcttgttgactaacccacatttactaacgatgatgtgtattctagtaccagtttatcgagggaattcacccagaccagtttaatcacagaatcccggaaaattttttccaccagggtctt

SEQ ID NO: 8217 - DNA, 377 bp, Diabrotica virgifera
  Clone ID: LIB3026-035-Q1-E1-E6
ccgacgcgtgcgatagtactccacggtatgacttaattactgtgtatcgacgacctgaatcgttccactaatatgttgatgtccaaggttaacaattagaagatctcagattcagcttcggactgaagtcaacgactggactgtgtatatacataagcgcgttcagcatactgaatcaccaacatcagaccattctttctcaagggaaaacatgctatgcacactcatacacaatttaaagctctccctcttaagatcatatacataattaccataaacctccatcgctcaaacatcaaagacctagtgactaacctccttcgtgacaccatatccaacgatattgataaggcctgccagagtatctaccccctaga

SEQ ID NO: 8218 - DNA, 418 bp, Diabrotica virgifera
  Clone ID: LIB3026-035-Q1-E1-F11
caggaatgttttatacatcatatcttttaaataccaatatgtaacaaatttgatctttacgacatttaaggggtttttacccaaacattttggtgtctcgggcatgtgcagtactggaattgtacactgatgatggaattagtgttccgaaaatgttctgtaaccctttttggggattatttaaatataatttttacaaaggaacatactatcgtttgtgatttatggtatacagccagctacaggaatttattttcctcgtggatttttttaaacaaacatttcgtgagctacaattcttattgataattattagtgaattttgttatattcaaagctcaggtatatttttgcagatttaaaccagagttgaaaccgatgtggactttctccttatttttatacttttttgtcatta

SEQ ID NO: 8219 - DNA, 204 bp, Diabrotica virgifera
  Clone ID: LIB3026-035-Q1-E1-F3
acacaacgacatccccctatggacttttataaaactaggaatacgtttttttagtacgaactttagttatataataaatttacttaacctggggcgaaaaaacatcatttactttttaaaattatatacacatcgaagtttgtgctacaacttttttgattataacaataacttagcctagggataaccacgtaattttattgg

SEQ ID NO: 8220 - DNA, 277 bp, Diabrotica virgifera
  Clone ID: LIB3026-035-Q1-E1-F6
cccacgcgtctgcccacccgtccggtttattttaaagtactatgctagtttttcacttaggtaatcaaaagttttagttactgacaggtgcatagtcttgtgagagaagagtttattttgatgtaggggggaatttatgtattgtaccttgtgtagcacggagtacttctttataagtagctatttattagtttcgacattaaagcagttaggactttacaatttttatggtaaagtaaatatttgaaataacttttgtgtcatgacatgtttttcg

SEQ ID NO: 8221 - DNA, 441 bp, Diabrotica virgifera
  Clone ID: LIB3026-035-Q1-E1-G3
cccacgcgtccgattctttctcagcggtggcatttagtattggtgtcaagccacgcgctgagcatgtttacaaatattgagaacaaagaaatatatttgatcatcaaattaaataatgcaattgcccgaattattgtttacaatttacaattcgtgaactaaattagaaacccgtacatgtattataccataacaacttggctcatgtgatatacggggtgataaaaatatactgttcaatatcggatatgaataatgaatgtttgatattggacatgctgcggacggccaagtaagtactgcccgacgaaataagtaataacgaatgtagtcagtgttcaaagtttacaataatcatgatacattaggttaccaagataggttaataaaatgtgtgatgtaaagacactatatagtccttgaacaaataatacttttcca

SEQ ID NO: 8222 - DNA, 423 bp, Diabrotica virgifera
  Clone ID: LIB3026-035-Q1-E1-G4
agggctgattaaacaatggcttccaaaactgttcttttcggactcttggtagtccttttggtcaaccactctttggctagagatctgactgtctgtcccaactcagacaaagcaaccaaagctgtatacgacaaagaagtagcaacatccgttgtaggaagcaccatccgtgttagagtaccagacagcttgttcttgaagaaaccaatcacctgcattgttattgtggacaataaccacagcgatagcgtacctgaagtagaagatggtggtgttgacagtacatgggtgaccgtaaacattgctcccgcaattacggaactgctcagctacaaaatcaaattgtacaccaatgaataagtataaattgtaataggtcggaattatgtaaagtggtgctaataaaaggctaatgtgttttat

SEQ ID NO: 8223 - DNA, 419 bp, Diabrotica virgifera
  Clone ID: LIB3026-035-Q1-E1-H1
ggaacaacggaaaatagtaaaaaatatgataaaagatccaaagaagaaagttggaaacaattcggggaaaaacaaccaggaactcagataatagataacgaagataacagttttgttgcaagtatgacagcataatgttaaaatatagatgtagaattaaaaaaaaaaaaaaaaaaaaaaaaaaaaaaggggaatgaacaaaaagctaaaagaataaataaaaaataaatacaaaatcaaaaatcataaaacagtgtcaaaaaaaaacaaaaaaaaaaaaagggggggcccccctaaaggatcgaagctaacttcggcgtgaagcaaactcaaaacccttccaaaagggccccctaactcaaattgccgggcgtccgtttaagaacgccgtcatggggaatacccggggtttcccaaac

SEQ ID NO: 8224 - DNA, 379 bp, Diabrotica virgifera
  Clone ID: LIB3026-035-Q1-E1-H10
cgtaaacatgaagactactttggttttggctgttttggcttgtgtcgctcttaccgcttacggtgaaaacgtccaagttaatgactttttgtgcgacacctgcgtaacttttgcatcaacaggccctgccacccaagaccgagcttcaccgctttgtgaagtggcccaagtagcaaaagaactttgtgacctcctaccgggggatttgaaagatttctgcgagaaagatttgcttccagaagtcgagaatatctacaatgatgtatccaaaataacaccccaagaagcatgccaagatttgggattctgtgacgcttaaaaaattaaaagaattgttgtaatatgcataactatagaataagaaaaattttgaagtagc

SEQ ID NO: 8225 - DNA, 347 bp, Diabrotica virgifera
  Clone ID: LIB3026-035-Q1-E1-H4
caaataatgtaaaccaaccagaaggcaatcaagctaccacttcaaataatgcagcagatggagatcacaatgaaggtaatagaggtcccacaacaaatgatataacaataattgatccagaatgtcgagaattagatctaaatcatggccgggtagataagcttcaaaactttgagccacttacatgcattgagaggttgtatttaagatggaacctaataacaaagattgaaaacctggacaccctaacaactctaattgagctcgagttatatgacaatcaaatcacgaaaattgagaaattgggatgcctactaaacttggagaatctggatttgtcgtttaac

SEQ ID NO: 8226 - DNA, 378 bp, Diabrotica virgifera
  unsure (1)..(378): unsure at all n locations
  Clone ID: pGUT002
ctcgtgccgcgttatgacgcaagaaatcaagcgaaggataatcctagcaaacaaatggtattttggactgagtagacataatatgagaagcagaaacttaagccaaaaaacaaaaattaccagatacaaaacccttatacaaccagtgttgacatatggatcggagacatggaccatctccaaagcagataaaaacctgcttatatttgaactaaggatcctgagatgcatattcggtggcatctgtgataatggtatttggatgatgatgtacaacgacgatgtataccanagatatanatatatntggtggtaaagacgtagtatctcttataaggatcacaggaagatatctagcaatatcacagcataacaacc

SEQ ID NO: 8227 - DNA, 232 bp, Diabrotica virgifera
  unsure (1)..(232): unsure at all n locations
  Clone ID: pGUT003
gaaattttacagaattgacggtagatatctgcctcttattaacaagcaggggttgataagcaactttataggataatgctactgtcttagccacgttaatggagagtaaattacagtcataccaggtttttatcgtaagaagatcacaagtcataattgcatgaagagttgcaatagttgactcgctctaatattgatgtaaggctcggagataaatanctgctggctttca

SEQ ID NO: 8228 - DNA, 358 bp, Diabrotica virgifera
  unsure (1)..(358): unsure at all n locations
  Clone ID: pGUT012
cccaactcaagaatatccgtcacaaaaaaatcatagcatgtgatctgtctttaaaaagacaaccaaatgcaacgatggcagtaaaatgctcgcgttagattattttaatataatttaatatatatttaataatataattcaaagaagctctaattaactatcctaaatgaaataaattatgtcgcaaattcctcggtagaatgcagtaagatgtggttacccatactgaaagaggaagtctatagaaagaaaataccacgattggtaagtcnataacatatcgagttaatacaaattttatattttagtattactcaatgtatatctatgtaacattaatattagttatcatttaaac

SEQ ID NO: 8229 - DNA, 76 bp, Diabrotica virgifera
  Clone ID: pGUT019
tttcgttcatgttctaaaagtgacaaagtctttccattttccatttaactaaatgtgttccacaatggcttccggt

SEQ ID NO: 8230 - DNA, 160 bp, Diabrotica virgifera
  unsure (1)..(160): unsure at all n locations
  Clone ID: pGUT021
agatattcaccagggggattntttggcaatattatacgagtatatnnttagcatcatcatcttcattggctcacagccaaaatgggccccgaactgtttcaataatcccaaatatttaatcctatttccaaacttccgtgtccgaattccaatttccaat

SEQ ID NO: 8231 - DNA, 418 bp, Diabrotica virgifera
  unsure (1)..(418): unsure at all n locations
  Clone ID: pGUT028
acaaagccaaaaatgaagctaacaggtgtatgttttttaatcgtggctttttgcgctatcaacgcattagcaagaccttccgattcggatgatccattaccagatggacaaactaatgcaccatctgttccaacatcagattctccacctgacacagtaactgattcatcatctactgcacctacagattctccacctgacccagcaactgattcatcatctactgcacctacagattctccacctgaaccagcaactgattcatcatctactgcacctacagattctccacctgacccagcaactgattcatcatctactgcacctacagattctccanctgacccagncactgattcatcatctactgcacctacagattctcccactgagccagcaactgattcatcatctgctt

SEQ ID NO: 8232 - DNA, 337 bp, Diabrotica virgifera
  Clone ID: pGUT036
gtcgttttcgattattgagattatccgaatgcgtagacaacaaatataacaaaaacttgaatcgtttattgttattcatgattacgctgacgagatgccagggatcatgaagactttcattgtactatctttcctttgcgtcgccgctttggcctccgaagatttttgctatcaagacgcagttaccgcatgcaatccaactgctgcgaagtatgttgacaagttgaattgtacagccaaatttggagctatcgatgcagttgaatctgacctacagaagttcataaaccatcatttcatcagatccttcgagtatctactcctagccaccaatttt

SEQ ID NO: 8233 - DNA, 419 bp, Diabrotica virgifera
  unsure (1)..(419): unsure at all n locations
  Clone ID: pGUT039
acaaatataatttatttgttacgaaaattgaattaaccctcaacaaacattacttttcacatttatgttttttacccgattctggatatgcgcttgtcacatggagtcacctgacatcgagggactccggacccctatatacatacaagcccggatcctccaggtaggtccaaactccancacggtcccggaacgatatagaccctgctgtgtgcatgggttcggtgctgacacgtgtgcgggccttgctctccacttctcactcaggcggagactcgctgcttgtgcgccatgacataagctaccgggccaaacctgaccatatatcgtgcaacccctgcatttattatggaaaaaacatgccgtctgccactgccctgactggcgacgtgccctcccagcatttaatgtgtcccgtc

SEQ ID NO: 8234 - DNA, 381 bp, Diabrotica virgifera
  unsure (1)..(381): unsure at all n locations
  Clone ID: pGUT040
ctagtctcgagtttttttttttttttgagttttttttagttctagcgcaaaccttaggacgaaattttggcaattattgctataaatttattatataaaatgaagtatttatctgttctatctattttttgctttgtgggaatagcgtttgctgctatttcttttcccaaagaacagggtctangatatatatcggattgcctgttttgtacaagtgttgganatcaagttaaattgctgcaaaaacacaatctttcaatcgaagaaataagagacgttatattccaagaatgtactttgcccacggattggattttcttcgttagctgcgaagcctatataggcgagatcataaacggagtattcaattcaaccaatttg

SEQ ID NO: 8235 - DNA, 302 bp, Diabrotica virgifera
  unsure (1)..(302): unsure at all n locations
  Clone ID: pGUT050
cggtgaacgtgacataccagtcagcgtggataacttggagacagcagacaccgctatgattgattatgatgtgtgcatggccgtagtagatccatcgatggattacaaatttcctgatttggcccaaacattgtcctgcactggagattttactggacgcgaagatttgtgttttgtcagtaacggatctccaaccatccaagatagagtcgtantacgtatttatcattctccaaccttagcgtgtggagtaatgggatcagctatgttaactctcaagactggaccttatgtctcgtgga

SEQ ID NO: 8236 - DNA, 301 bp, Diabrotica virgifera
  unsure (1)..(301): unsure at all n locations
  Clone ID: pGUT053
ctcatgccgaattcggcaccaaaaagactacaccattcagaagatcagcttgaatttttggctcgtaacagtttctgacccactgcccaataaaatcaaatgctaatacagagaagtcaagtcagaaatcatcaaaactaaccacgtgctcaaactacaacccacttgcgatgcccttataggtagtacaagagtacactcccagaaattgattgacgcttacgacaatgttacgtactanagtcatccagttcanatacgattcagttgttgcaatcacttctcagacaaaatctttcca

SEQ ID NO: 8237 - DNA, 166 bp, Diabrotica virgifera
  Clone ID: pGUT057
tgtttgactctatcctggtcgggacccttactttcttgcaacgatatgaggtaccaacgccgaggatctgatgcgcgaactatcccttctccttattagaccatgaataggaggtggtgtcttaatatattgcatcacccactattcttccggtaaatttttctgt

SEQ ID NO: 8238 - DNA, 263 bp, Diabrotica virgifera
  Clone ID: pGUT066
attcagcacgagcaaagacctatcaactgcttactgctaatcgatcaaaaaggaagcaccagctcaccaaaaattatacaaggtggatatctcgacacttttgctgtagtaaatatcactaccacaactgcgcaaccagttagtcactatgctatagtatttattgattagcctattttagtagtatttagctatatttatgcagaaatattatttatttaaatgatatatatgttcgtcaataaattactaaaataataata

SEQ ID NO: 8239 - DNA, 320 bp, Diabrotica virgifera
  Clone ID: pGUT067
gaaacgactactaagttccaagacacatctcttgctagagccacttacatcttgtcagtaacttcagtatttgtattaagtgctttagtagtactgaccatagctgtgaccttaactctatgcattctgcgcagaaacaaccgctttgacatgcaacgagctaacttaccaaggctgaaaattcctctttggaatacaactccaggtcaaaagaaacacagtgggtctgtatacagacctctttccgaagacctctcgggttccaagactcctagattgagtcgctatgattttaatacaaccccagtagtgcatactgc

SEQ ID NO: 8240 - DNA, 279 bp, Diabrotica virgifera
  unsure (1)..(279): unsure at all n locations
  Clone ID: pGUT070
cgcttatagatagtgtgactacgactatgtctaaaatagtacttcttttgtttacgattggagctatggcagttttttccgccgcaaagcaagaacccacagtatgttattcctgtacaatttatgacggagatttgtgcaatgacctgaacctatctaaccgtacgaaagtaagatgcccagatatgccccagataataagacaacctcaggtgtagcttgttatactatttatcgtaccttgtatggtactacgttaactganagatgatgcaccta

SEQ ID NO: 8241 - DNA, 217 bp, Diabrotica virgifera
  Clone ID: pGUT072
gattattgcatgagattttaataaaagggtaacaaatcaattgaaagttctgtctgacacaacacatgggacgtctttgtagtcagagtccgaaacttgtaagctgtgtcacaattacaactacacctgttcacgtatatcagggtttgtccggctacacagcgtcgggatattaacacattttcggctggctattaataaactttatttggtaccc

SEQ ID NO: 8242 - DNA, 330 bp, Diabrotica virgifera
  Clone ID: pGUT073
actatataaatcgcttctggcttattttgactaactatatcgtacactactgttgtgaatgtgtctgcagctaaattgttctctaattttgccgcaggtgtatctattttttcaggatttacagacatgtgttcagttggaatttcctgtaatatgtcttctgtattttgcaatattgttacagacttctctacttctataaatgtggtattaacatcaagagtgtctcgtatttcttgatttgtattctcatctcttttgagatcagtcttttgctgaatagctgcaacagtatcattttggtgggacggttgaaatgtcatcttcccc

SEQ ID NO: 8243 - DNA, 182 bp, Diabrotica virgifera
  Clone ID: pGUT077
tgacaacgctaccagcatcgtccacgattacttcaacgaccaaaatcgagaagctcccgagctctacttcgatattaacaagtgccactttctcgtcaaattctgactttataaatctaatattccagtaaacatttggcagatagaatgaactgggatatctgtgccttccttttccaaaa

SEQ ID NO: 8244 - DNA, 198 bp, Diabrotica virgifera
  unsure (1)..(198): unsure at all n locations
  Clone ID: pGUT079
tatctaagctaatgtactttatattttcctttcgcaccgtagattcaacagctgagtagcaaataaaaatatatgattcataaatcatatattttgtatacatcagtgaacactgatttatatatgacgtctcgtatgtatgaaaatacgtataaatcgtagcgctctcgcagtggtactatggtttntctgctgtga

SEQ ID NO: 8245 - DNA, 185 bp, Diabrotica virgifera
  unsure (1)..(185): unsure at all n locations
  Clone ID: pGUT080
accaatcgtacttataatggtgttggtcatactgaagatttggcctacatatttgactataacaaaaaacgaactgaacatgattacttggcaagagaacgaacagtgaggctatgggcgatctttattaaatatggcgacccaactccanagcgtgaatcattactgcagaatgtcatctggcc

SEQ ID NO: 8246 - DNA, 126 bp, Diabrotica virgifera
  Clone ID: pGUT082
ctcgatggcataacatatgcgcaattaacaaagataattcctatcccgttttgtaaattttaaatttaaatttggaccaacaacaatgaaaaatgtgatataaatgtataataaactaataatagt

SEQ ID NO: 8247 - DNA, 303 bp, Diabrotica virgifera
  Clone ID: pGUT097
tacgcaccggagagagtctctttaggagtggaaagcagtgattccgatggggttgttgctagagtgatgggtcaagactacgtctacaactatggcgttaatcttgatctacggtacgatcagaggcaggctttgctagattatttgagagatgttagatcaattcaggatatccgggaggattttgtgaagagtgattctgtctgctgcgttgtgattcgagagtatacagatcatgctgtggtgaagtggaggccacgcgcaaacaaggatggatgtgatcccgccagatcttgggatcac

SEQ ID NO: 8248 - DNA, 209 bp, Diabrotica virgifera
  Clone ID: pGUT098
cacctgcattgttatcgtggacaataaccacagcgatagcgtacctgaaatcgaagatggtggtgtagacagtacatgggtaaccattaacattgctcccgccatcaccgaacttctcagctacagaatccaagtgtacaccaaccaataaataatataaatattgtaatatgtctgagtagaattgtgatataaagtctaatgtgtgt

SEQ ID NO: 8249 - DNA, 221 bp, Diabrotica virgifera
  Clone ID: pGUT099
ttcaaagtggatttaaaaaattattcaaattgccttgtgaatcatcgatatacaccgctaaatgatagcgatactttttgctttaagacacatatttagtaacgaaccctataggtgcataatatttacagacagtaagagtgtcgttgatagactaactaacgtacataagtaccaacaactcattcttatagaactggaaattatgactctttataaaa

SEQ ID NO: 8250 - DNA, 362 bp, Diabrotica virgifera
  Clone ID: pGUT101
tgcacaaaaaactatttttttttttcaaaatactcaagattattgtgattacgataaggtttctaaatacaatatgattagcaacagcaatcattatcctttcaagggtctaataattataaaactgactggacattgatattttaatttgaccctgtcaaattaaaagatgtcatccacttgttttattcaacatagataaccctaggggtaatcaaaacaatcgataatatctgctatctacatcgacacaataaatagtaaaagtaaaacatctactaactgaacaaaatgaatcaatcagctggataaagacaggtgattgtccctgtcctattaaacactgatctcactgttcaatc

SEQ ID NO: 8251 - DNA, 311 bp, Diabrotica virgifera
  unsure (1)..(311): unsure at all n locations
  Clone ID: pGUT1012
aaaactacaaacggaattggagaaggattcgaagattattggtggagtagctattggtatcgctgttgtaaagattgttggtgctatcttcgccttgtgtctagccagttcaatcaggaacagttacagaagacacatatacgcctaaaacgaaacaaaatctttatttatttgttatagttttctctcactttaaaaattttactgttgatttanaatttttactctttttgtaccttaataataagtttattataaatgttgtaagttttcatggacggtatntgacacagaacaatgaattaacgact

SEQ ID NO: 8252 - DNA, 331 bp, Diabrotica virgifera
  unsure (1)..(331): unsure at all n locations
  Clone ID: pGUT1014
cggcacgaggttgttttattgagcctaatttccttggcacttgttgcttgcgatgattcagttagtacttcgacagacactccggtaatatcaacagaggtaccagcaccgatatcgacaagccttcgtgaagatacagtttacgtagcaacttcaaatgttcncgacccagtcttccagatagatgccgtggaagtattcanagatgctaaggcacttcatccggttgacggtatagctttgttagaaacatnttccgatttgttttacgccaaacataaagtatctggatgaatganagttgctgannaatatgattacttttataatc

SEQ ID NO: 8253 - DNA, 323 bp, Diabrotica virgifera
  unsure (1)..(323): unsure at all n locations
  Clone ID: pGUT1015
atggataattttttttattattgccacttttgaggggtatcgttgattggaaggttgagaagaatgagaattataaaaagaactaaagttaggagagcacttagtaataattaaatagttataagatggttttatttaagtgtataaaggtagaattacataagaaatcaaaatagataatcctatatcaaagatgatatttcaatgacatataaattagaaattagtaactagaacatataataatttgaattttgagtattaccagagaattacttctatttgtaacatacaatagccttatntgttcgtaagaatcatca

SEQ ID NO: 8254 - DNA, 183 bp, Diabrotica virgifera
  unsure (1)..(183): unsure at all n locations
  Clone ID: pGUT102
tcttcaggtaaccgacataaatgagagttttagtacaccagttatagaagaaggtggatatggaaaggagtatgtagttttacgtattgacccagttcaatcaggagaacaactgcagtacgatgtacagatntatgttgaccaataatcaagttatctttaaataaattttttggtctgtac

SEQ ID NO: 8255 - DNA, 324 bp, Diabrotica virgifera
  unsure (1)..(324): unsure at all n locations
  Clone ID: pGUT1025
ctgtaccaaaaacataggttccacttgaccttgaataactttatggaattttatatagaaacatgtggatttagagctaggaatgatattaaaaattgtatctatagatagttagtcgaaatatatagtaaagacnagaagatatgatnagaatttatggaaattataaattttccggtcatcaatatggcttcctatatggatgatgtaataatacaacttagccgatagcaatcatcccaaatntttaccanattaatacttttcttctccaacaaaacaaaactttctcctcccttcacttaattacgatagcttccgtat

SEQ ID NO: 8256 - DNA, 314 bp, Diabrotica virgifera
  unsure (1)..(314): unsure at all n locations
  Clone ID: pGUT1027
gttgcattgtagttcatagagagttgaaatccatttgaccatgatgtggtgtagtcaaagacagcctcgttgtcagtgtcagcactgatttggtaagcttgaatttcccagtcggcaagaccataccatctattatcatggagctcgatatgggcgttggcaaccattaaagaacttttcctttcacagcactactcaggatncatcaagataaccatgaaacaaccagtatggactggaagattcagcgcacannanaccccactgacttaaaacctancaccactgtagacagttttaccgtcgactggcac

SEQ ID NO: 8257 - DNA, 313 bp, Diabrotica virgifera
  unsure (1)..(313): unsure at all n locations
  Clone ID: pGUT1030
tgtcgcacttgttgcaaaatagcaataattgcgaaaaatccataaaaaaacaagtattcgcattttacggtttttaaccatttttgctacataaaggaccttcatattttacccagaaaaactctatgatatagtaaaataacactgtaaattttattaagatcggtttaacagattttgcanaattaattttgcaatccagctttctcaaaaaaaaatcatttttcaaaatgttgcaggactganaataaagcaaacagcaagttgattttttttaacatatagattaataatgtacctttcatttccaatt

SEQ ID NO: 8258 - DNA, 251 bp, Diabrotica virgifera
  Clone ID: pGUT1031
ctcgtgccgatcggcacgagttaagaacttattttcagatgcaggctgagacatctactctacatcgcgctatctgcgcagtagatgacacaacaccgatcaaactgagggaagcagaactgcgcataaaccaccttactaaggacgaaaaagtgcgcgcctggatgggtaaacctttgcacgggcgacatcccaatgaggtcagccaagattatgtcgacaatatagcgtcgaactactggttgacatca

SEQ ID NO: 8259 - DNA, 120 bp, Diabrotica virgifera
  Clone ID: pGUT1038
ttcgtgccgactgcagcacgaacggatgtacgtcttgaccttgattaactttaccgagtctcatatcgcaagttgtggatctacagctacgactgatatgactcctggtatctatacata

SEQ ID NO: 8260 - DNA, 206 bp, Diabrotica virgifera
  Clone ID: pGUT1041
ctcctgcctaattcggctccatgtgcccagttctgccaagctcgtgccgtattctgcacgatctgcccactgatttatttcaatagccacggtatgatgaccgtgctaaggtctcattatcattaatttatatattgatagctggattgaagggttggattatatataaactatcattatatcctttatagtgatttttattttta

SEQ ID NO: 8261 - DNA, 234 bp, Diabrotica virgifera
  Clone ID: pGUT1044
gtcctacggagtccactgcacctccaacacctgctccaactactgcaaacccaactggatcaacaatacctccatggcttcgatgtgacgtggacggcgaatattttccagatacaacgaattgtctagcattttacgaatgtattaacaacgtaaaacagcatatgatctgccctgatcctcttttgtggaatgttcatttacctggatgtatctagagctctgactgctcgc

SEQ ID NO: 8262 - DNA, 257 bp, Diabrotica virgifera
  Clone ID: pGUT1050
aacaaaatgaaattcgcatctttgctttgtattgtgatcttcaccgtccttgtgatcatcagcgcggtgttcgctgttccgtccaagggatcaaccaaggcatctctacagaagaaaccatgtctaaaagactgtagtgctgttgagtacaaaccagtttgcgggggagacggaactggatagggagacaaaagcttcggcagcgaatgtgtcttgggtaacttcaactgcgaacattcaaccactctgaaagtggt

SEQ ID NO: 8263 - DNA, 243 bp, Diabrotica virgifera
  unsure (1)..(243): unsure at all n locations
  Clone ID: pGUT1074
gcgactcgaagtgaggttgtctgtggtgtaaatttaattttttaaatattataaacatcccttgaggatttaatttccaagatggtccanaagaaacctaagaagaaggtaggataganagtatctgcagctcctcttgcagtcnagaaaattgaacagaaaaaagaaattaacccactttttgaaaagaagcctacatatnttggaattggtcaggatattcaacctccccgtgatttatct

SEQ ID NO: 8264 - DNA, 83 bp, Diabrotica virgifera
  Clone ID: pGUT1084
ctctctctctctctctctctctctctctctctctctctctctctctctctctctctctctctctctctctctctctctctctc

SEQ ID NO: 8265 - DNA, 186 bp, Diabrotica virgifera
  unsure (1)..(186): unsure at all n locations
  Clone ID: pGUT1089
cttaaggatgtcaggcacttctttaagagcgtttttccgtactgaggcattaggcgcctcggagaatgtttcatgatcagtgtttanagcatctttattgtaagggactagatagtagtcctttgttcatgtcaaaattatattatcaagttttatttttatttanaatttaagattatgtataat

SEQ ID NO: 8266 - DNA, 333 bp, Diabrotica virgifera
  unsure (1)..(333): unsure at all n locations
  Clone ID: pGUT109
gtcacatataattcaggcggagccttctttcacttaagtgtcgtatatgggcagttggtgtatcatttgttaattctgaattttatacttataaactgttcagcactaatgtcagagttatatcatttctcctctcttgtttgcttattgtcgaagaagcattgcaaatttttccactgcttagtttttatcaatatattcgtgataaactgtcgtaaacatttanaaattcattagaatctagggacacattgataaattctattttgttgttatcttttaatctagtttcgtcgtgactagtctttatatcaatatgtaatgatcaacgtg

SEQ ID NO: 8267 - DNA, 264 bp, Diabrotica virgifera
  unsure (1)..(264): unsure at all n locations
  Clone ID: pGUT1093
tggcactccnaattcgcttggaccatgctcatccctatgtgtctcagagatgaactctcgctatcactcgctccgatctccctggcaaatacttgaaaaccccattccactggcaacctccgctgtactctgactaccaactcaccatcactcacttgcacgggtgtcgctatgaattcttcgctggccatcaatatcactcactatccactaaaggaagatttacctcctccacaaaatctattctctctctcgtactccccc

SEQ ID NO: 8268 - DNA, 409 bp, Diabrotica virgifera
  unsure (1)..(409): unsure at all n locations
  Clone ID: pGUT1095
cttgaaattaaattggcccctgcacttcaagatctgtcccaaaataagactctccatatcagtcgctccaatttcgctggcgacttcctgatagccccattcctcttgcaacctcctcttacatttttctacgaactccccaacactcacatgctcgggtgtcgtataaaatactttgctggcgaacgatccagctttctttttactgacaggagattttcctcctccccagaaaattttctctctctcgtccgcccccatggtagtaactggaagcaacaacaactccacaatcttctttggcaaaacttccgacactgcctccacaccttcagcctcatcaacccaataactcttgtccagggcnagtctcaccccattcgtcgaatgagatgctcaatctcattca

SEQ ID NO: 8269 - DNA, 341 bp, Diabrotica virgifera
  Clone ID: pGUT1104
aaaatatcgtatacattagattcgcggacatcatcgccaaaagcatagtatgccacatcctcgtcctcgtataactcagtggagatcggtatatgtccaaatgtaccacctatatccgagtcgtggattcttcctatataaatggttgaatttatattaacaatttgatgccagttggagtgcactggatggtagtcatcactatcgaaccattttggtaaaaatgtttgatttgtgctaacccattcgactttggctccatccacaacagttaggatctcaatgttgtcggtaatatggtaagttaaatcaggataactagcattgagttgtaaaactcc

SEQ ID NO: 8270 - DNA, 285 bp, Diabrotica virgifera
  Clone ID: pGUT1107
actcgtgcctatttcggccctaacacgcgccgacttcggccccaaaatcactatatgcctcgacctcgtcttctggcatctctatagagatcggtctatgtgtatgtgttcccccaatatgtcagtcgtggattcttcctatatatatcgtgcaatttatgtgaactatgcgatgccagtcggagtgcactggattgttttcttcaataacaaatccttttggtattcctgtgagattagtgcgatcccattcgactttggctccatccacttcgattatgatct

SEQ ID NO: 8271 - DNA, 192 bp, Diabrotica virgifera
  unsure (1)..(192): unsure at all n locations
  Clone ID: pGUT1116
gtaaacatgagttttagacaaaataatctgccggtggggcagctatacaactccacgtactcgccagttcaagctacatataattatacgaaatcaattgaaaaaatccattcggagcttatcatancnaactaaaattgcctaataaagtcacataagtaatgaacctttcgactctcggaactcccccag

SEQ ID NO: 8272 - DNA, 488 bp, Diabrotica virgifera
  unsure (1)..(488): unsure at all n locations
  Clone ID: pGUT1129
aaaaaacgtacatatcaaagtcaaaatcaatgattttgtcaacctactaacagatttttgagtgttaaatcaaaagatatggatttttctatttaaattactgtgaatattttttaaagtaatgtcacacaaacacacactatcgtacactctancggcgaaattgggtatcattttttagttgtaaaaaacagtacttaattccccaaacacacacacaaattcacgcacacatgacattttataaacagaaaaaattaatgaaaaaatttattaaaaaaaaggaaaaatcaggtacgacgggttaaataacataaactaacacatgtattctgtctctanaggacttcaggacatctccattcattatattccaacgattttccttgtcncacgacatntctttcttctgttatcanatccgtacagtttttgggcaccatatcattgcgcatgacctaagtcttctcagcctgttcttttttttg

SEQ ID NO: 8273 - DNA, 389 bp, Diabrotica virgifera
  unsure (1)..(389): unsure at all n locations
  Clone ID: pGUT1130
aaaaaacgtacatatcaaagtcaaaatcaatgattttgtcaacctactaacagatttttgagtgttaaatcacaagatatggatttttctatttaaattactgtgaatattttttaaagtaatgtcacacagacgcacactatcgtacactctagcggcgaaattgggtatcattttttagttgtaaaaaacagtactaaattccccanacacacacacaaattcacgcacacatgacattttataaacaaaaaaaattaatgacaaaatatattacaaacaaggacaaatcaggtacgacgggttanataacatanactaacacatgtattctgtctctaaaggacttcaagacatctccattcattatattccaacgaatttccttg

SEQ ID NO: 8274 - DNA, 289 bp, Diabrotica virgifera
  Clone ID: pGUT1131
ccatgatgaaggtactcattcttctttccgttgttgccttgagcagctgcttaccagcgtccagaaatcaacatatgcattgatgtatactactacagctacaacgctcatcccgtctacgtcttctggaggacttggactcagcaactctatggacaagtagggtggaaccactgggtagtatatggtgtcccgatactccccgatcactactggaggccgtgcgtgcatcacatcttccaagctgattatgtcgatgtaccttggatgtatcactcttgggatgtcc

SEQ ID NO: 8275 - DNA, 201 bp, Diabrotica virgifera
  Clone ID: pGUT1137
cgaggaatctccaattcaggaatctccaccccgctccaatgctccaaaccatctacttccccccgatagcactctgataagctagagggactctcaatcagcaaagttcttatcacatgggagtcctgggtacacgggctcccacatgaaatcctaccccgagtcctggctctgggctacatccagttcggtgactcggcg

SEQ ID NO: 8276 - DNA, 423 bp, Diabrotica virgifera
  unsure (1)..(423): unsure at all n locations
  Clone ID: pGUT1138
caagtacaaccccaattagaaaattaccttgaacaaagtccaatgtctcaccaacaatatccatggtctcaaagacaacttatgtaccatgtaatgtatgaattgtaccatcattatggtcaagctccatggtctcaagaacaaatcagaaaccacattgtacaataccaaaatgctttccctaaccaattatctcaagagcaaatcgaacaattggtaggatttgtatacaacattcaacaggaactgatgccaatgcactaccaacaactcgaacaaatgcaaccatggggccaatataccgctcaaccatcaaactatcaaacttattattcaaggaacaaccaaaatggtttgtcatggacctacaaaacaactcaacaaagatatgaagctgcccaancatggtcctacagacaaact

SEQ ID NO: 8277 - DNA, 115 bp, Diabrotica virgifera
  Clone ID: pGUT1139
tgctagttggagtgtgacaaacttgcatgaagtttgtttattcaaacttgatacaaacttgctgaaggtttgtttttgttttgttgcatgaagtttgttttcacaaacttgatac

SEQ ID NO: 8278 - DNA, 126 bp, Diabrotica virgifera
  Clone ID: pGUT1141
ctggagtctgctgcccaaagaaagctgaagttgctgcttaagaatattgttgattgttgttattttctaatgaaatctaaaagttgttaaaggttatatttttataagtgtaattttttttctagt

SEQ ID NO: 8279 - DNA, 63 bp, Diabrotica virgifera
  Clone ID: pGUT1144
ttgaacatccaatcagaacaaagttataatgcgcatgcgccgggctgataggttttaacatat

SEQ ID NO: 8280 - DNA, 272 bp, Diabrotica virgifera
  Clone ID: pGUT1149
atgactttttgtgcgatacctgcgtaggattagtaaaagtagtccaggactacgtacgaaaagaaattccattggaagaagttgaaaaagaagtgaaagaattgtgcaaagttttaccaggagatttggataaattgtgcgaggacaagttaattccagcaatcgaccaaatgtacaaccagatggatgacactcctcctagagatttatgcgtagagttggaattctgtaattaatttgtttgttagaatattataataaaaactcaaaat

SEQ ID NO: 8281 - DNA, 412 bp, Diabrotica virgifera
  unsure (1)..(412): unsure at all n locations
  Clone ID: pGUT1154
aataaatataatattgtagtttcgaatttaattaataaaaattcaaatgtccgcctatggattttttgtcaaaaaagttgacgttttttaattctctagtagtttttatgtcaacgtcaacctgtttgacaagtaatcataggcggaattttgaatttttattaattaaatgcgaaactacaattttatatttatttcatttgttcatcaaaattagcttaaactcaaacaaaattagtatgactgaataggtattttcaatacctttcanacgaagtatcacttgccataaggtcncatntaaaattatcggtcacagtggctctgtaacgtcatctgtcactattacgtcacctgtcatgactagttaagatgcttacgtccggttaatttcttcctccaaatttcacta

SEQ ID NO: 8282 - DNA, 141 bp, Diabrotica virgifera
  unsure (1)..(141): unsure at all n locations
  Clone ID: pGUT1155
tctcgatttttttttttttttttttttttttttacgggtttccccaatttcataaaaaatatacatatataaacaataagtaaaagtaagagtagtagtaaagtccagtanaacagtcgaaaaaaaaaaaaaaaaacccca

SEQ ID NO: 8283 - DNA, 173 bp, Diabrotica virgifera
  Clone ID: pGUT1159
ggctcgatcgcatgccgactccggtgtatcgagcaatctttttgtcctctatgaatctcgtcttgtctctgcccagcatgttttatctcgctctcataatcgtgttgtgtttctgcctctctgtcttatcggatctattattctcgtgtccaactccgctccagggggggccc

SEQ ID NO: 8284 - DNA, 458 bp, Diabrotica virgifera
  unsure (1)..(458): unsure at all n locations
  Clone ID: pGUT1185
ccgattcaagtacattttttaataataattgaaaaaaaggattgatatggtaagagtaataagtaataatatacccttatatttttatcattttatagaaaattgtagactaaatatattttagtttaatgattcctaaaatttataaaactcaaacaactttcaagctgattatctcagaactataaaaactgcacttaaatcgttttacgtctgatcccctcaaatagtctctcgtcgttttggaatanaatccaatcaacgttttaggtttttcatttctcanaaaaatgtggagagtnctatntgctattgctattgtcactactttgagttttcgatatnctntctaatgtcttcttcggtgctttcanagtctcactcttcaaaaaccccttgatcttcaatatactgtntactactcacagtctaattgtcaaaatcttaactaatgtgtg

SEQ ID NO: 8285 - DNA, 367 bp, Diabrotica virgifera
  unsure (1)..(367): unsure at all n locations
  Clone ID: pGUT1199
cttgacggtactgtaggtgcatcaaaagcttggggatctcatggtctaaaacccgacacatttggaggtagagtggactattcccacaagccatctggatcttcagcttttgtaaatgctgacagaactcccggttacggaacagatgttacagctggtggaaaatacaatttcgcaggaggtaaaaattggggtgctgacgctagtgctggatataacaggcattttggaggacccggtggtaccggaaaaccccaagtgggcgctggagtanatgttcacggcaatttttanagaataatntatnttgtattattaaactatttataaatannnnaanaaaaaaaaaaaaaaaactcgaaggggg

SEQ ID NO: 8286 - DNA, 335 bp, Diabrotica virgifera
  unsure (1)..(335): unsure at all n locations
  Clone ID: pGUT1205
cttttgggccttgcccttttcgtctcagctggtcaagatcttgacaagggcatggaaattgtgaaatgcgcccagcgagcaataagcgtaggagtacctgaattaggagttccatcacataatcccttcgtcgtaattagaaacgtatcatggactggatcaatcggtgttgcaagcacccatatcgaactcaataccaataaatggtatggtcttgcggattgggatatctcnagctagcaaatcaatgacgacgatgatntcgatgctgtctntgactacaccacatactggcccagtnttagaatcgtaggcaactacaaaccaaccgttaa

SEQ ID NO: 8287 - DNA, 327 bp, Diabrotica virgifera
  unsure (1)..(327): unsure at all n locations
  Clone ID: pGUT1210
aaaaaagaaagaaagaaagaaagaagaccggtaaattatatgacaaagtgacacaataattgtctgaaaaagcatacaaaatccttcaaagtgagagcttgtacagtaatttttgctaatgtgtttgctanattattggaaacatagtttcaaagtcgatttnttgaaaatcattaataacttttctaaaaatgcacaaaacctttaattttgcctgagaatagagaaaatatcacaagtaggtattcagctataaaatntcanatttnttttcacttaatagttactgcaaaattgaaataattaggcaacaagttaacaaaaata

SEQ ID NO: 8288 - DNA, 120 bp, Diabrotica virgifera
  Clone ID: pGUT1216
aaaaaactgaaattgctaggacgcgtctaataatttgagcagtgactgtataattatgatattttcggtattagtgaaatactgttccaatgttttgagtaaattcttactcaaaattcc

SEQ ID NO: 8289 - DNA, 346 bp, Diabrotica virgifera
  unsure (1)..(346): unsure at all n locations
  Clone ID: pGUT122
atctactatattaaccgtatttttgaccaagataaaatttattatttttttaaattccttttaaaatgataacaaactctttgtataaatataaatattttaagttttaaaagtggatacatttttacttaacataccacacatactatcctgttaatttnttgtttaggggagattggggcaaatagttcctcaacattttttagatcanaaataacaaaaaaacgatatactcaagttcaatttaatcaaccagtaagtggggtaactatagcagatcatttttctntgatnaatctncatcaaatctcctatnttctttctttttntaacacttttcctgctt

SEQ ID NO: 8290 - DNA, 250 bp, Diabrotica virgifera
  unsure (1)..(250): unsure at all n locations
  Clone ID: pGUT1220
cttggagaaactaacatcgttgacaaccatggcggataaagaaaagaaggtcaagaagaaaaagaaggaagatggcgatgcacctgctgccgctcctgcccccgccgaaaccaggtcctcctcaaagagttcctccaagaaagccaaaaggtctggttccaatgtcttctccatgttttcgcaatctcaagtagctgaattcanagaagctttccaacttatggaacacgacnaagatggcatcatctct

SEQ ID NO: 8291 - DNA, 321 bp, Diabrotica virgifera
  unsure (1)..(321): unsure at all n locations
  Clone ID: pGUT1223
aaaagctccgcgaaagcgcaagctgctgcccccaaaccaaaagccgctgctgctaaagctggaaaggctgcaggcaaaggtgctgccaaacccgcagccaaagctgcaggaaagaaaccanctgctgctggaaaggccaaagctcccgcaactcttattgctaagcccaaaaagaatgttcctgttaaacaacaacagaaaagtgttggcaaaaagccagctgccattgcagtgcaagtancgagagcacttaanatccanaagaaaataattaaaggcccaatggaacacactcaaagaaaatccgtaactcagtccact

SEQ ID NO: 8292 - DNA, 215 bp, Diabrotica virgifera
  unsure (1)..(215): unsure at all n locations
  Clone ID: pGUT1230
gagtttntttttttttttttttttttttttttttttttttttttttttttttttaaagctgttattatttattttacatacaaaagatcacaaaacacgtgaacttaagcagtttccgcacgagctgggccagtgacaggacggtgattcttanccaagtagtcagcaaactcttggtatggtgtcttagccaaagccatatccttccacaaatc

SEQ ID NO: 8293 - DNA, 387 bp, Diabrotica virgifera
  unsure (1)..(387): unsure at all n locations
  Clone ID: pGUT1231
gtgacgtctagctcaaaaaataataaaccaattttaaaaaaccaaagtgattattgttcgttcttaaattgtcttcgatatgaacctccaatcggaatanaaaataagttttaagtgcatnttaagggcaaataactgaaaaacaacggtaaaaattgatgtttttttttcanacttgcgaaatttntcanatntttgattttttagccgatttgaggtttatatcgaagagaaacttgtaatanacgaaaaaatnnttggatttttgaatttatgcggaaattacgaactctacatgtcacgcaagcgacatgttcgtgcggcgaatttcacgggttgcggcctacacctaacaatgctctatttttaaataatataacttaaaaa

SEQ ID NO: 8294 - DNA, 354 bp, Diabrotica virgifera
  unsure (1)..(354): unsure at all n locations
  Clone ID: pGUT1234
attcggcacgagacggagcagaaactctcacgctcacaaaaacaacagcactaaaaatgcgagtggcataaaggcgcatcaaaagatcgattgtcggcgtcncaaaaaagatggaccagaaaactaattgactggcgcccaacgcagcagacgacgaccaccaacacgctggatggacgacaagaatgttcaagaaatggcaccaagacgcacagaaccgtgaagagtggcgaaaaatgggagatacctatatccaccantggaaagacgaagttgcatgatgatgacacttannananaactatactaaaatcagataagctatgtaattgatgttaacataagttaacagcg

SEQ ID NO: 8295 - DNA, 281 bp, Diabrotica virgifera
  unsure (1)..(281): unsure at all n locations
  Clone ID: pGUT124
tggcggtcgctctagatctagtaggatctcccatggctgcgggagctcggctccagggggggcgcctgtccacttctggaccatggataattgctacaacaaaacattggccgtcctattatatcgtcttgattgggaaaaccgatcgtaaatcggattactcggcttgcagctcctctgccattcaccatctggcttggtaccaagtaggcgcgcgtcgatcgcccttcacaccattggcggaggttgaatggcgaatgganaatcgtaagcgttaagat

SEQ ID NO: 8296 - DNA, 251 bp, Diabrotica virgifera
  unsure (1)..(251): unsure at all n locations
  Clone ID: pGUT1241
gtgtagtaactttattttaacttaaataacataaaatcaacagcagtaagtgccaatatatatcaataagtattanatggaggtcttccatattccatatacaaactgtcccaaagtanaatcttgtcagcatttggaagacctaccacttttagatctttgttaatttcaaaaaatntcaagttttcaagctttatgacaacagaatntgctggccangtgacgttctgtaataataattcaagctttgg

SEQ ID NO: 8297 - DNA, 333 bp, Diabrotica virgifera
  unsure (1)..(333): unsure at all n locations
  Clone ID: pGUT1242
cttaccatagacaccgatggaaacttatggttaacagcaatctttggttcaactctagtcaaaattaacccagatgatggcaaacttctggaaaaaattgttatgtctaccccacaacctacttcaatttcatttggcggcaagaatctaaacgaaatgtttgttaccactgcaagaattccagttgatggcaagattccgcctaatcctgcaggaacaacatatatcatcaaaaacacaggtagttctggtttcaaaggggatagaatacaatcgtanactataccgtgtaatagtgtctnttatatnatatntaatntaatanactatgtg

SEQ ID NO: 8298 - DNA, 379 bp, Diabrotica virgifera
  unsure (1)..(379): unsure at all n locations
  Clone ID: pGUT1243
aacaagccagatacccaactttactggaagatcacggaagatgtgttgttaccaatattgcagtaggtgacgatagaactataaggagtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagttattctgtaggtttgtcctgtnttgaacgaaatggtgctcctctagcgagccttttcatttcaacaagatctccatttccaccanaagatctggtggattcgattctccaagttcttgacgacaacaattttgctat

SEQ ID NO: 8299 - DNA, 301 bp, Diabrotica virgifera
  unsure (1)..(301): unsure at all n locations
  Clone ID: pGUT125
ggagactggcttccagcaaaagtaattccaggcaaagatatcgcctacgtatcttacaatggatccgagattggagttcaccgcttccaggttctctgcgaacaacaattcgactgggtaccatgtcacggcggtaacattccaccagacgcagtggaaggatgtanaacgtccgatggagatcctttatacattggcagagcttaccacgaaggttcncaaacagtaggataggttcacccaagtcacggttgttgctacgtaccattcaacggaggcgaacacagccattccaactatg

SEQ ID NO: 8300 - DNA, 385 bp, Diabrotica virgifera
  unsure (1)..(385): unsure at all n locations
  Clone ID: pGUT1255
cttacgttgttaacattgtatcgttggtgcataaaatattaataaaaacaccatattctacctagttggctatgactttgacactaaactttcttaaacattagacattatactatttttatagttccagttgcttgttaccattgctaatatgaatttatctaatggggaactgattagtatggtattgatctangacctangagagtataacaaaaatgtagtactagcactaataatttatcatctgccattccctgatagacgacaaccaagatacttttttagaatagtttcgacgtattgacatttagattacgagaacgttcgtactaatatgcagattctcaatgacactancgattacattttaatcatntataat

SEQ ID NO: 8301 - DNA, 336 bp, Diabrotica virgifera
  unsure (1)..(336): unsure at all n locations
  Clone ID: pGUT1257
gacagaaagtggaaatgtcaaaaaagaggagacgaccccctttcataatgaccgattcaattatatataaattcaactgttaattctgacactattaatttgtacggcatgtaagacagtgtagcttcgctaacatgtttgattggttgcgatacaataatatntgatgagttgttactgtgacagaattatgtcaccttactgttttcagctcccggactaacaggcgccgaaagtgttttacaaaanctntttttatacaatgatttatgtggttgattgatttatgagggaccctaatttaaagaaagatctctaccgagttgtttacatata

SEQ ID NO: 8302 - DNA, 230 bp, Diabrotica virgifera
  unsure (1)..(230): unsure at all n locations
  Clone ID: pGUT1268
aattcggcacgacctgctttagtacggccacagagttcgtaatctttgtagttacattatctataacatcttgagttaatgcttctttcatatcgggcatttcccaaactggctctgttagaaagtaatcaataatgttgctatcttctttctttanaccatcccaaaaggtgtgttcactaaaataaacgtgtaattgaaacatgttggcactggtacctcgtgccgaa

SEQ ID NO: 8303 - DNA, 222 bp, Diabrotica virgifera
  unsure (1)..(222): unsure at all n locations
  Clone ID: pGUT1276
gttttgtgtatcaaatatacaacaacgtgaaaattatattttatattgatgaccatgaaagttttactattgttagcaatttttgtaccatttgtggtaggccacgatgtgaagattacagaactactctctcaagaaatcttgagagatgttgatgttgaattattactanaggaaatggagacaatttatttatttgaaaaaaagagttctgganatata

SEQ ID NO: 8304 - DNA, 234 bp, Diabrotica virgifera
  unsure (1)..(234): unsure at all n locations
  Clone ID: pGUT1281
gcacaaatcagatagatggaaagagcagagggagacctatgtccatcagtggacgcgtccgggttgattatgatgataaagaatgttaccgttgatattctctgcttaattaaaatcgaagtaactatttattttcaaatcagtcaatatacgatattgcgataattctcaacatcctanaacataacaatacgtcattattggacgcgggcctgagaaaatntctgccgtgat

SEQ ID NO: 8305 - DNA, 477 bp, Diabrotica virgifera
  unsure (1)..(477): unsure at all n locations
  Clone ID: pGUT1284
catttaatatcttatttatttatttatatcaacaattaatgttcacttgaataaattagatttatcaacaatgtcttcttcttatcttcaatatcttcttattcttcgatatcttcttattcttcaatatcttcttattcttcaatatcttcttgttttcgttcagaaagccgactctgtatttttcgattgatagataccgaagtaccttaattataattaaatcaatttattagtaattnacactgctgaaagcagcttcggctagtccacccataggaacttgacttcttatcagtgccanaaaacttgactatgactggtattatnttactgttagtagttaaaatataatnttattanaactaggttagattaataatgtatggatcttactttcaatattctttttaaatttacactgtaagtttcttaactcacttatttaaactttgcaaataatttggtgatttttct

SEQ ID NO: 8306 - DNA, 243 bp, Diabrotica virgifera
  unsure (1)..(243): unsure at all n locations
  Clone ID: pGUT1289
tgtattaatattatatctgtgtattaagattatcttaaacttaatataacatataatcaacagcagaagatgcaaataaatatcaataagtaatggttggaggtctaccatattccatatcccacctgtcccaaactaaaatctagtcagcattcggaacacataccacttttagatctttattaatttcaaaaaatatcacgtttgcaagatntataacaacagattatgcaggccagctga

SEQ ID NO: 8307 - DNA, 310 bp, Diabrotica virgifera
  Clone ID: pGUT129
cgagtttttcttttttttttttgtgtttcagattggtttattttttgttataaaatgcatttatgttttattagcatcagcactttttatttagaataacaatatatttttatttagaaaaataatagcgttaataacttccactagctggacactttttcaattggatgcatttgtccattactgtgtcagtgtcaacttcgtcataaaaggaatcaacctcctctagatatgagtccaagcatagtcgcgttgtatcttcagttgcaaacactacttcacaacacaaagtcttttgcgatgtcgctgt

SEQ ID NO: 8308 - DNA, 93 bp, Diabrotica virgifera
  Clone ID: pGUT1291
ctctctctctctctctctctctctctctctctctctctctctctctctctctctctctctctctctctctctctctctctcctcgtgccgaat

SEQ ID NO: 8309 - DNA, 263 bp, Diabrotica virgifera
  unsure (1)..(263): unsure at all n locations
  Clone ID: pGUT1300
ataaaaacacaatggttacatagcttttgaaaggttgtcatgggctgatattttattcgtttgtgtatatgaagcattagtcaatcttgcaggtaaggaggctgtancttcttaccctagtttacagcaagttaagaaaaatgttctagcaacaaaaggtattaataaatggattanaaataaaccagcagtggatggatacaatttganacaagatctntaagatntntttatatatttntatttaatanataattattatt

SEQ ID NO: 8310 - DNA, 371 bp, Diabrotica virgifera
  Clone ID: pGUT1309
agataatatactcgtattttattttaatctaataacgttctaataagtacaatcatcttggtctgtttcgagtatttgctcacgatcaatattgttgtcgtcaagaacttggataatcgcatctatctcatctcgtgttggaactggagttcttgttgtaaggaaaagactctctagaaaaacaccattgcgttcaaaacagacgatacctacagaatagttttcatagtctgtaccaagaacatagaaaggtacagttacgtctggatttaacatatgtactagatatcgaccttccccagttgttgaaccttgttgtgcttctccttctagaacgtgtgtttcatttgtctctgaattgatatattgcg

SEQ ID NO: 8311 - DNA, 108 bp, Diabrotica virgifera
  Clone ID: pGUT1317
gaactagtctcgagttttttgtttttttttactactaaataagtaagaattaggtgattctagactcttgttgacattttttttgaagtgaataaacatagcattttt

SEQ ID NO: 8312 - DNA, 338 bp, Diabrotica virgifera
  unsure (1)..(338): unsure at all n locations
  Clone ID: pGUT1323
ccaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgccaagagcaagtaaataagggtggttttccatttgttaccaaacaggctgatgttgaatacttaggagatccttcaaaagttatttactgcgttcaagctctcagctctgatgacccaagcgttgaatctgttgctgaaattacagttggtggagttggtcacaatttcgtanatgtacatttgacatctaag

SEQ ID NO: 8313 - DNA, 393 bp, Diabrotica virgifera
  Clone ID: pGUT1327
ttgggctgtagtgccattggatggatggatggtatgtgacttaacaaaaaccgacgtgcgactacgttgaaactcgtcgccaaactcgaaaccaacttttgacggtcgccatcatgtacaggattatcagcatccaaaataagagcaacacatattcatttaatttttaaatgtcttacaaaataaatatcacgtttgttgttggataatgaggtggcatcgattgctcaacacgagtgcactagtttcaataacgctttgtcagctattcaatatcattcttaattcacggccaaaccgagtcagcattataaacatcaacacttctctagttttattataattacaaaataacatcgcggatcattctattatcaatgatcattcgtgatg

SEQ ID NO: 8314 - DNA, 369 bp, Diabrotica virgifera
  Clone ID: pGUT1334
agataatatactcgtattttattttaatctaataacgttctaataagtacaatcatcttggtctgtttcgagtatttgctcacgatcaatattgttgtcgtcaagaacttggataatcgcatctatctcatctcgtgttggaactggagttcttgttgtgaggaaaagactctctagaaaaacaccattgcgttcaaaacagacgaaacctacagaatagttttcatagtctgtaccaagaaaatagagaggtacagttacgtctggatttaagagatgtactagaaatcgaccttccccagttgttgaaccttgttgtgcttctccttctagaacgtgtgtttcatttgtctctgaaatgatatattg

SEQ ID NO: 8315 - DNA, 369 bp, Diabrotica virgifera
  Clone ID: pGUT1335
agataatatactcgtattttattttaatctaataacgttctaataagtacaatcatcttggtctgtttcgagtatttgctcacgatcaatattgttgtcgtcaagaacttggataatcgcatctatctcatctcgtgttggaactggagttcttgttgtaaggaaaagactctctagaaaaacaccattgcgttcaaaacagacgaaacctacagaatagttttcatagtctgtaccaagaacatagaaaggtacagttacgtctggatttaagaaatgtactaaaaatcgaccttccccagttgttgaaccttgttgtgcttctccttctaaaacgtgtgtttcatttgtctctgaattgatatattg

SEQ ID NO: 8316 - DNA, 282 bp, Diabrotica virgifera
  Clone ID: pGUT134
tgtcagctttggtattcctttcagtcatcgcactcagctgtgcccttacctttggtaccggcaatcaagtcaccatcaacgacgatggcactctctccatcttgggagataatggtatgaaaatcatcatctcaaacgccatgggaggcactggaccaaaagatattgaaatctcaatcaatggaccatacggagcagtcaaaaagatctcagtatatggcgataccaacgatagaccatcaacctcgtcgaaccaagcttgtctgagcaatacaaccctga

SEQ ID NO: 8317 - DNA, 285 bp, Diabrotica virgifera
  Clone ID: pGUT1355
agtggaaccacaggtaggccaggttgagagtagtagaacctctttgagccacgagttcccggtatctgattgcagtatcgaaaaaggttgaacacagcatcaccacagaagcaggaaacgagagctatacgagctagtttcagaggagaacattactggagaccatgacgacgtttagattgcagcccaggataccaggaagagggtctcgtgtgaagacattctcagttcaccagacaaaggtcagtctcgtatgtttggacatgaatgtatggaattttcgta

SEQ ID NO: 8318 - DNA, 341 bp, Diabrotica virgifera
  Clone ID: pGUT1356
ctttcttcttctctgcttgacatacaataaacaggtcaaacttgatactcccccacagaccaacaataacacgttgggagagaagaaatgtctttattattaaatccacatttactgcaaaattcgcaattttttgcaaaattgcaaaactacacaaagcggattgtagccatctaagacccacaatcccaatctaatttattgacataaaatgcatatgctcctaacttgacatcaatctttgaaaatatccagaaaagcgcgcctttcagagtttaataataaaaacaatatattcgtatagcgtgtaaaaaaggatttattgggatgagcaactgaaa

SEQ ID NO: 8319 - DNA, 322 bp, Diabrotica virgifera
  unsure (1)..(322): unsure at all n locations
  Clone ID: pGUT136
gaaaaacgtctctcagccgaacgaagtattcctgcgtcttcgcaacgtcgtgaaatcgtccaagagatcacgacgatcaaacaacaaagtctcgtagaggataaactagcggaggtgaaggatataataaaaacagaagatacaacaaaaaccacagtaacgataaccacgatctcgccggataccataacggtttctaaaaccatcgaagtaaaaaccacattaccatctgattcgaatgtntcggatacggtttcgtctcctcaagagatccacgttagcanaaccaccatagtaacggaaacacgcacaattcaccctg

SEQ ID NO: 8320 - DNA, 323 bp, Diabrotica virgifera
  unsure (1)..(323): unsure at all n locations
  Clone ID: pGUT138
gaaaaacgtctctcagccgaacgaagtattcctgcgtcttcgcaacgtcgtgaaatcgtccacgagatcacgacgatcaagcaacaaagtctcgtataagacaaactagcggaggtgaaggagaagataaaaacagaagaggcggcacaaaccacagtaacgacaaccacgatctcgccggaatacaaaacggtttctataaccatcgaagtataaaccacattaccatctgattcgaaggtntcggaaccggtntcgtctcctcaagagacccacgttagcataaccaccatagtaacggatacacgcacaattcaacctga

SEQ ID NO: 8321 - DNA, 323 bp, Diabrotica virgifera
  Clone ID: pGUT1382
agataatatactcgtattttattttaatctaataacgttctaataagtacaatcatcttggtctgtttcgagtatttgctcacgatcaatattgttgtcgtcaagaacttggataatcgcatctatctcatctcgtgttggaactggagttcttgttgtaaggaaaagactctctagaaaaacaccattgcgttcaaaacagacgaaacctacagaatagtttgcatagtctgtaccaagatcatagataggtacagttacgtctggatttaagaaatgtactaaaaatcgaccttccccagttgtggaaccttgttgtgctt

SEQ ID NO: 8322 - DNA, 318 bp, Diabrotica virgifera
  Clone ID: pGUT1384
agataatatactcgtattttattttaatctaataacgttctaataagtacaatcatcttggtctgtttcgagtatttgctcacgatcaatattgttgtcgtcaagaacttggataatcgcatctatctcatctcgtgttggaactggagttcttgttgtaaggaaaagactctctagaaaaacaccattgcgttcaaaacagacgaaacctacagaatagttttcatagtctgtaccaagaacatagaaaggtacagttacgtctggatttaagaaatgtactaaaaatcgaccttccccagttgttgaaccttgttg

SEQ ID NO: 8323 - DNA, 291 bp, Diabrotica virgifera
  Clone ID: pGUT1385
ccaaaatgaatactttattggtagcttcagtcttctgcgccatcttcgccatcggcctgaccgtacctgttctgacaggtccaggtccagctttccaagttaccgatggagaatgtgagaatgtctcaagagacgaattggtccgcccagagcaagtacataagggtggttttccatttgttaccaaacaggctgatgttgaatacttatgagatccttcaaaagttgtttactgcgttcaagctctcagctctgatgaaccaagcgtcgactctgttgctgaaattacag

SEQ ID NO: 8324 - DNA, 273 bp, Diabrotica virgifera
  unsure (1)..(273): unsure at all n locations
  Clone ID: pGUT1406
ctttgttggagctgatagaactcgtggatacggtactgacgttaatgctgggcttaaatacaattttctgcaaaagaaaaactggaatggagatatcagcggacaatacggtaaacatttcggatggcctggcggtactggcaanccacaaactggtgtatttttgaatttaaatggaaagtcttaaattagccactaatcttaaattcccgtgataacaatgtgttcatttttatactctgtaattttataaataaataagtattacctttt

SEQ ID NO: 8325 - DNA, 270 bp, Diabrotica virgifera
  Clone ID: pGUT1409
gtcgtgtccaatccagctcgaggtatggtaccaatccacttacttattgcaccaagaccggttatcccaccagaactgatccgttatcacacaagaactcatcctcttgtagagagagtcctaccagtatgtagaaaaacttccgcctatcttgattcctccatccgtctatcgactcacctactgcgaacactagaatccactgttccgcaagaatagatttcccattcctccaccattggtttcccattacttcaccaggttcaaccc

SEQ ID NO: 8326 - DNA, 155 bp, Diabrotica virgifera
  unsure (1)..(155): unsure at all n locations
  Clone ID: pGUT141
tgagaatagtacgtggtaaaaaccagtgtggtatcaatgaagtggccgattatcccctcctataattttaaaaattgtcatgccttacaatataatgaaacatacacaaaatattatnactnacggaatgtgaatgataaaataaaaacataaga

SEQ ID NO: 8327 - DNA, 189 bp, Diabrotica virgifera
  Clone ID: pGUT1410
gtcgtgcccaggtcagcgcgatggctaacactcgttcccggtatagccactatgttcacctgatcgattcacgttgtgtatctgaacgatttacattctgtcgtcctacacttatttcgccgacgagatgactgtcgctcgccgaatacatgatcgccgccatatcaatcgtcttacacctaccttaca

SEQ ID NO: 8328 - DNA, 372 bp, Diabrotica virgifera
  Clone ID: pGUT1412
ggaactacatccattgatggtagacaattatatattgcccgtgcctttgttagtttagatgagtctgatctttattatgacaatcaaggttacatagtaggcccagtggaagcaggagttttacaactcaatgctagttttcctgatttaacttatcatattaccgacaacattgagatcctaactgttgtggatggagccaaagtcgaatgggttagcacaaatcatacatttttaccaaaatggttcgatagtgatgactaccatccagtgcactccaactggcatcaaattgttaatataaattcaaccatttatataggatgattccacgactcggatataggtggtacatttggacatataccggtc

SEQ ID NO: 8329 - DNA, 419 bp, Diabrotica virgifera
  unsure (1)..(419): unsure at all n locations
  Clone ID: pGUT1413
ccaaaaatgaagctaacaggtgtatgttttttaatcgtggctttttgcgctatcaacgcattagcaagcccttccgatccggatgatccatcaccagatgaacaaactaatgcaccatctgtttcaacatcagattctccacctgacacagtaactgattcatcatctactgcacctacagattctacacctgacccagcaactgattcatcatctactgcacctacagattctccacctaacccagcaactgattcatctgcctcacctacagattctccatctgactcaactacgaaaggttcanctgcatgtctatttacaagcaccaacatatttatggctacatttgtaatcctggtttcaaattacttgtaaatgtaagttacatcaaaataaatattttttgtatgtatgcc

SEQ ID NO: 8330 - DNA, 287 bp, Diabrotica virgifera
  Clone ID: pGUT1419
tgttttttaatactctaattatatttttgtaactagttaattgcattttattaagtacaaattgattattcacttacacacagcaatatacgtaggtgtttaaaattataaggtttagaaaaaccacttcattaatatcacattaattgataaggatataaattattaatatattattaaagtagtgtcaccccatttcctacgtaatcactatgaccgacaaaaacgaagatgtaccacaaactaacgtaaatgacgaactatcgaatctcttaaacagtgcattg

SEQ ID NO: 8331 - DNA, 401 bp, Diabrotica virgifera
  unsure (1)..(401): unsure at all n locations
  Clone ID: pGUT1428
caaaaaatgaaatcaattttcgttattacattctttgcttgcattggtcttgcagtatcagttgcaattccaatgaacataaagggtccagctccagatttagatgatccanactgtgtagtctgcttttccgctggaaatnttattcaaagatntaagatctcaggtgattccanngaagatgcanaacaacaaaaatattttatctgtaacctgtttaacactgacgagctaatgcaaatctgtatgagcacttatgatgaagacgtcgaatatatntatggagtaactgaactcagtacagtaactgaaatgtgcatagatatgagcaaatgttaagctaaaccaaatatataattgtatttttttaataaaaaaaaaaaaaaaaaaattcaaggggg

SEQ ID NO: 8332 - DNA, 187 bp, Diabrotica virgifera
  Clone ID: pGUT1429
tggaaactccatcagaaaattccacaagagaagacaactccaccacaggagaagatatggatacaactaatgaagattgtgatcccggcaacgaaaaaccgacgcaagttaacttggaatccgaggaaagttctactaaaaaaagcatggatagtgaatcaatcgaagacgatgatgatatggatga

SEQ ID NO: 8333 - DNA, 318 bp, Diabrotica virgifera
  unsure (1)..(318): unsure at all n locations
  Clone ID: pGUT1431
cttgtcttctccaaaccaggagatgagaaatagatatatgtccttgtatattgtttaagaaaaaaatagaaaaacctttgtttatttgaataaaatattcgaggatgaaaaaatnngtntatntgaatattatattccaaggaaaaaaaaaaaaaaaaaaaaaaaaaatatatttcatattcttctttattatttatattttttttttttttttttggggggggggggggggggggggcgccccccccctttttttttttttttttctccccccccccccttaaaaaaaaaaaannccccccctcccccccctccccc

SEQ ID NO: 8334 - DNA, 267 bp, Diabrotica virgifera
  Clone ID: pGUT1434
gatgaaaacttgtgtggtattaacctcatgaactcttaccctaaattgtaaatgatttaatgcaaatgaaacaccaaatagaattcaaaaataaaaataattaaaaacctaccaaaaaaattcaaaaataaaaatatcttcaacacctctatactcataaaaaaaaactactttctcctctcttttttttctattttttttgggggggggggggggggggccccccccccccccttttttttttcttttctccccccccccccccct

SEQ ID NO: 8335 - DNA, 358 bp, Diabrotica virgifera
  Clone ID: pGUT1439
ctcggggcggattccggacaacttcgtcccgagtgcggcccaaggcccccaggctgcgtgggggggaaatttttcttacttttctagggttttcggctattatcaacgctgctccaaagttcaaatcagacataaagagctgctacaaagaatcgtgcccagaggataccttcgcatgtgaaaagactagtaaaatttcaccagaccgaaaacatattttacacgagattcattgtctcggactgaaggatgattcttaaaaaatataaccagttctgtgccaaattcctttggccacgcattatctacgcaagttatcaatacagtggtactattgaataattcacaccattacccg

SEQ ID NO: 8336 - DNA, 304 bp, Diabrotica virgifera
  Clone ID: pGUT1441
acgaacgaggggtaaatagcataatataaacagaccatgaaacgtgccatcattgtagcactcgctatagctacaacactagcagctccatctgacgtccaaggtccacttcaacaattagcaattggaaatcaacaactaacgtcaaatgtatacaaagaaattcttaaaactaagaatggaagtattatcttcagtcctttttctgctgaaaccgtattagcgctgacctctgaaggagcgaaaggtgacactagaagccagctaatatctgcgctacaccttccagaatcacaagagacta

SEQ ID NO: 8337 - DNA, 231 bp, Diabrotica virgifera
  Clone ID: pGUT1442
caccaagttgtccaacccaacgaaacccaagagcttcttcttcaaagcgtaaatggatcgtctttgaaaattatcaacgaaaacgagactgattacgctatcttctcagctgaaggaggtgaagtagttgatggattcagatatatggtaagaccactacgtcgccgtcccggtgcaagaaaaatgttctatggattttaagtatttaaataaaatacacatgctctgaat

SEQ ID NO: 8338 - DNA, 338 bp, Diabrotica virgifera
  Clone ID: pGUT1443
gttttatgaaaaacagacgggaatttctataacaggtacagccaatctcaaatcagtcgatatcagcaacagttcagacaaaaaatggagtttgcatttaagttatgtaaaagtataccaatatttgaacagtaataacccggcatactatgatgtagacagatcaattgatcaagatactcaaaatatgccatatgaacctccacccacaacgatcacagaatcaacaaccagtactatgacaactagtactacaacaactagtactgtaacggaaagtacaactgaagatactgggaccactaagagttctacacctacaatggaaagtacaactg

SEQ ID NO: 8339 - DNA, 329 bp, Diabrotica virgifera
  unsure (1)..(329): unsure at all n locations
  Clone ID: pGUT1446
tgtggatccgccgttttccaaatcatccaatcaatccgcatggcttaatcttgtaaatcttatattttatttaaaaatatatgtttaatttggatttttaatatatttccgtttatttcgtattgtgcaatcctttaaatataaattatgtgtatataattctcatacgttaaagtcttctaaaggctttagaaataatatacagttatttgcatttgacaactcaattttataattgtaggtacttttttgagattttntaccattccaatgttagttcatttgcatttatgtaactgagtctattttttcaatataaaataattttc

SEQ ID NO: 8340 - DNA, 194 bp, Diabrotica virgifera
  Clone ID: pGUT1448
ttgacgagcggcacaagaaaaatcacgtcggcattcgaatctttgtggacgcgaacaattatgaacacattgtcataatcattatccgaatcgagctcactctcgatgcctccctatataatgccatcgcatgcgatcttgcgcaccctgtattcagttatactggatgcgcttgatgtcgtccggccaccgtg

SEQ ID NO: 8341 - DNA, 220 bp, Diabrotica virgifera
  Clone ID: pGUT1449
ctcgtgcccaatccagaaccaggactcgggtgttttatgtgtaataaggagggtttttaatactttattctataaccacaccccccacactaatctgtcaactcaaggaggaggaattttcttttggaaacacaaatctgttgaaacccgtactccaccaaccccgtggaaggttaatagtccttggattttaaaggcgttaataaaaaacaaatttttt

SEQ ID NO: 8342 - DNA, 338 bp, Diabrotica virgifera
  Clone ID: pGUT1452
gccaaataagcattatttattatttattggggtaatttatatcaaaatcatttattgttagatatttgatgtgtaatgaataaatggttaggctgaattgtaaaactcagcagaaatgttatgtgcaagacattaaagcatattcttagataagaaaaacatgtctgaggatgataaaatatataggatttattatcttacccgaagatgataaaaatcatatgattgtcttttctccttataaatacacgtgggattttcaaaatactttaccaaatattcactgtatttgtgtaattattttatttggaaatttttggggggggggggggcccccc

SEQ ID NO: 8343 - DNA, 609 bp, Diabrotica virgifera
  Clone ID: pGUT1455
agattttactaatatttcaccactcgttgccggtattatgaaaacggaaaatgaagaaattcgacgtattattgaaaactatatgaaatcaaataatattgtgttggatatcaaagaagaaccagaagagaccgatgatgaaatggacgtcgaatttcaggacgttgaagtcaaaacagaaaagcgagagttttcaccagaagaactggaggaactttacgagggtatccacagtttaacaccgcagtgtttggacacagtttcaagtattttggacatacacgataattggaaaaatctggctcaattattggaaatggaacatttagttgatagtggtatgatcaaatccgaagcgaaagcaattttgactcatgcaatcgaggccaaccacgattggacaaatccaacctgtatctttgcgttacgtaaactttttggaaaacttggacgagatcgaaactgttgaggtatggacaaaatggtttttgaacttaaaaaatagacataactcattattgatgtacataaatggtttaaataaatttatttttctagatatcaacgtaccttataatctaatgtattttttaataaaagattatttac

SEQ ID NO: 8344 - DNA, 648 bp, Diabrotica virgifera
  unsure (1)..(648): unsure at all n locations
  Clone ID: pGUT1460
ctccattggttcgctggtgtgtgagtgtctcggactatttggacgcacctcgtacatggacttcagtggcgtgacttcagtgacgaaacgggcgtcattgtactgtacgtttttaacaaccattccaaaatttgtaggcctttctggcacaaaagtaggaaacaattctgacaagacaaaatagtatttttaaacaagacctttaatagagaaaacaatattaatatcaatgtacaaatattataattaatatttaatcttaggtaattatttataaatacttttgccaaaaaatgaatactaaaaaaataccgcaaaaatactaatcgttatttgtagggaactttgtatatttattctgtgttaagatgaccaacctatcaaaaacaaattggatntactctttttaaaattaaaataagttaaaattaaaatgaagcaaataaaaatgataaaagttttcttaaaaaatgtcgtattagaattttttaaatatatttataactgtaataaacatattaggcaagaaaaattcgttattagaaagtatataanaaaagtttataaatgaaatacttaagaaaatacttanaaagaattgtcaaggtaataccatttctttctgaaaaataaaacgttnntacaatg

SEQ ID NO: 8345 - DNA, 164 bp, Diabrotica virgifera
  Clone ID: pGUT1462
ctcgcgccgcacaccgcacgcgttaacggaacgcaccccgaacattatggctagggataccgtggcgtgaatcttataagcgtatggataggacattagaggtaaatgtatttgacagttttgagaaaagttattaacccaggggggggcccagaacccctttg

SEQ ID NO: 8346 - DNA, 403 bp, Diabrotica virgifera
  Clone ID: pGUT1466
ggaactagtctcgagtttttttttttttttggtttttttttttttgggtggggttttttttttttttttttttttaaaaaaaaaaccccccccatttttaatacaaaaaaaagcgggcgaaaaaaaaccacaacgggggggggcgaaaatgcttctccccccaaaaaaaggggggggccaaaaaaacggggggacaccccccttacccccggggggggggaaagccggttttgggagggggaaaaacccccttaaaaaaaccccccctctgtaaaaaaaaacccccccccccaaaaaaatttcttggggggcccccaaaaaaaaagggggggcccccccccccgggaaaaaaaaaagccgcaaaaaaaccccccccccccggggggaacccgggggggccccc

SEQ ID NO: 8347 - DNA, 132 bp, Diabrotica virgifera
  Clone ID: pGUT1469
gaatcaagtcgcagcctttaaaaacgactttttgaccttaatcgttttcaaagccaagtttgctgcaccacatgtcactctactagtctccttctacatttcatctgtagaacaaaatttgatagatcatca

SEQ ID NO: 8348 - DNA, 522 bp, Diabrotica virgifera
  unsure (1)..(522): unsure at all n locations
  Clone ID: pGUT1472
cccaaacgacacttaattttgcaggaattaggtacctcgaagagcgtctaaggacgcaaactgaggtctctgaggctgcggtgtcgcaagcaggcgtcacggcgaggtggataaatctatatttcaccggtaaagatttcggtgaaaaatatgaagacttcaatagattttgtcgtgaggaaagcggaaagttggacaaaaccgggttctataagaagaccgagcagactcctctaactatagaggagataatgaatggagccgaacatggattttacatcgcanagagtgaaaaggctaagaaaatagccagtaagctcttggacgatgatttaggaacctgggatggattgggttttactcttggtggggaggatatcgatttgggtgatcatgtgaatgagattgagcatctcatcgacgaatgggtgagactgccctggacagangttgtgngtgatgaggctgaaggtgtggaggcagtgtcngaaggtttgccanagaagattgtggagttctcgt

SEQ ID NO: 8349 - DNA, 177 bp, Diabrotica virgifera
  Clone ID: pGUT1473
gtttcgtttacggtgccggctaataaatgtggagttattattggtagaggcggtgaaacaaaaaaaaaaaaaaaaaaaaaaaaaaaaaaaaaaaaaaaaaaaaaaaaaaaaaaagggggggggcccaaaaaaaaaaccccttaaaggggggggaaaaaaaaaaaaggggggcggttt

SEQ ID NO: 8350 - DNA, 82 bp, Diabrotica virgifera
  Clone ID: pGUT1474
aatcagagtaataacaaaatagttggagactattcgttgacaagatgaattcaagtattttgggagttttaatggggttggg

SEQ ID NO: 8351 - DNA, 229 bp, Diabrotica virgifera
  Clone ID: pGUT1486
gggtaccatttttaatttaaatacatatccttttatttataccactcccaaattaattgttttacggtaaacatagttcctttagggaaaggggcaaatttggccccttttattgaattccaaaataaatttggcaaaccaattttatttaattacccaacccaaaataattaataagggtaaaaacttcccccgcggttccaaaaaaaccatcatttatttggcattt

SEQ ID NO: 8352 - DNA, 324 bp, Diabrotica virgifera
  Clone ID: pGUT1487
gtcctgcctactgtcgatggatgtccggtcttctgtcttaggttgatctgtacacctgcctcattacagccagaaaccgaactcttgagaggtagaaacaaatctatggcgacgtcaacacgtctacatattctggacgactcgtatacagcttctggatggactggaacatggacccaatggatataaactggtgacccaatgggtctagattggtgctggaggcaatcctcgctaccactgtatgcagtacgctctcactctctctctcgttctcactctcgctctaactctcactctcactctcactctggatcaatctct

SEQ ID NO: 8353 - DNA, 339 bp, Diabrotica virgifera
  Clone ID: pGUT1490
caagtatgatcccagttggcgcagtttgtctgttcaatgtctgcctaataaaaaaggtgcgttgacttaccgttagggaaaataattttttgggcttacaaaccaaggcgtttgttcttcaaatcggtgtcaagcgctccaataaagctagcttattgccgattgttgcaatatttttttgaaagtatgtaatcaatttaaatcatatcttttgtataaaaaaaataaaagtacatatgtgccattaaaagacacgtatggtcaaaaataacttccgtattgccaaaagatggtcggaatctgtcacacgtggcatttttcagccgactcatgctttat

SEQ ID NO: 8354 - DNA, 164 bp, Diabrotica virgifera
  Clone ID: pGUT1491
atcatgtccatacggatgtaaactaagtgcaaatggaggtcccattttgatcgatggaggtaccgctgagatcgatggatctcatgctgaaatcggcgctttttctttccatattggtgaatatacaatcgattgcggcgaaattgatctacaacgcgacatta

SEQ ID NO: 8355 - DNA, 378 bp, Diabrotica virgifera
  unsure (1)..(378): unsure at all n locations
  Clone ID: pGUT1493
gtcacgtttaaggtgatagtttatagaaatcaagaaaataaacaaaagttatcaaaatgggtcgatatgcacgtgaacccgaaaatgctgcaaaaacctgcaaagctaaaggttcaaacttgagagtacatnttaagaacacatgtgagactgcaaatgcaatcaaaaagatgccctcanaagagctgtagcctatntaaagaatgtagtaatccagaaagaatgtattccatttaaaaaatcaatggtggagttggtaggtgttctcaanctaaacagtttggtactactcaaggaaagtggcccaaaaaatcaacaaaaatttcttttacaacttcttaagaaatgctgaaagcaatgctgaaattatagtggact

SEQ ID NO: 8356 - DNA, 114 bp, Diabrotica virgifera
  Clone ID: pGUT1498
ctagtctcgagttttttttttttttttttaaaaattaacctaaataaaaaaatttttttttattttgggccctttcgtattaaaatatattattaactcaaaaacaaaaccccc

SEQ ID NO: 8357 - DNA, 121 bp, Diabrotica virgifera
  unsure (1)..(121): unsure at all n locations
  Clone ID: pGUT150
taaattgaatcttaatgacaaatttgccacattttgactaaataaacactttagttaccctaacacatttattcggtctttgatttttgataaaaaggtcaaaatgtcatcccagatcgnt

SEQ ID NO: 8358 - DNA, 159 bp, Diabrotica virgifera
  Clone ID: pGUT1506
cctcgtacgccagtcacgagaaaatttgtatttcattgcccccacatttcaaggttgctggattcgccgttgtacaatctacatgtttgaccacgaatttatcgtacgaccctcgtattatgcgattaaataccataaaaactgtatactctactttct

SEQ ID NO: 8359 - DNA, 320 bp, Diabrotica virgifera
  unsure (1)..(320): unsure at all n locations
  Clone ID: pGUT1507
ctagagctgatggcacacaacctcacgccattgccgtactaagccaaagaaccgatgggtacaaatatagaatggaatttactttaaaggatttgaatattaccgatccaaacggattcttgataaaggatatttttgatgaaaataaatctgtggcatccatagcagatgatgaaccgttcgtcctaagaatggcacctacaggatgcactttgttggttgcaactcccanaaaataaacgaaaaaggatttagtcagtgaacanaatattaaatactttttagatatnttataaataaataaataaattattttaata

SEQ ID NO: 8360 - DNA, 157 bp, Diabrotica virgifera
  Clone ID: pGUT151
taaattgaatcttaatgaggggtttgcctcatcttgaccaaaaaaacacattagtaactctaacacatggattcagtctttgatttatgataaaaaggtcaaaatgtcgtcacacatcgtactcccctagaaacatatccctaatgtccaagggggg

SEQ ID NO: 8361 - DNA, 155 bp, Diabrotica virgifera
  Clone ID: pGUT1511
gtggtacaacaactgttacgagagccatttaaatggtaaattcagaaacatacgttggccagcggcgtataagtataaaggaattgtctggtttggttttaaaaacaacgaatatttcttatctcaagcaagaatgttaataagaccgacgtgcc

SEQ ID NO: 8362 - DNA, 257 bp, Diabrotica virgifera
  unsure (1)..(257): unsure at all n locations
  Clone ID: pGUT1520
ctcatgtctaacacacaaggccgtatctggcaaactcaaggaacctaccaaagagtaccaatcatggtgcaaggaacctaccaaagagtaccactcatgatgtaaagactggtttatatttaatatgttgtttanaatatttattgttatgattgctacaaataaataaatattttttgtatattanacnccccccncccaccnnnnnnnnnnnnntccccccgggggggggggcgggaccccaacccccccaaaaa

SEQ ID NO: 8363 - DNA, 406 bp, Diabrotica virgifera
  unsure (1)..(406): unsure at all n locations
  Clone ID: pGUT1521
tgaataccacaaagaaaaaatgacagggcataaaaagaatgagagaccagttagtgctttttctacaataatacaccatgatatgtggctcaataatacaatgcaaaagattgtaaatggagttacagttaanaataagttttgcgatttccanatgtgtgaagtcaattctcctacgatcgatctaatgctcttcctttttagcagtgtagaattacgctgtcttgaaaataatgtagataacttaatcaaattctatcacgaagaacttgtaaatatattgaaaaaactaaacgtatacagcgaaaaatattgtnataaaaaacttttggaagattctacgattaattgtcaagaaagtatgttccacgcattaatgatgatacccacaattattttaagtgac

SEQ ID NO: 8364 - DNA, 316 bp, Diabrotica virgifera
  Clone ID: pGUT1523
gcgccaacaaagcaatgagaccaggagtacctgaattgggagttccacaacatgatcccttcgtcgcctttagtaagaacatatcatggcatggagacatcggtgttgctaacacctcaatcgacatcgacacattgagatggtatggtctcgccgactggaacgttactgctaagcaaatcaatgatgacgctgataatgtagcggtctttgactgggtcaatagatggcccgttttcacaatctccggcaactaccgagcaaccgttaaagaactgttccttacacagcattacaaaggaagcttcggaatggt

SEQ ID NO: 8365 - DNA, 373 bp, Diabrotica virgifera
  unsure (1)..(373): unsure at all n locations
  Clone ID: pGUT1526
tcgacacgtgccgtttcatacaagtataaatatgaattttttgcatgtagctttattttctcatttcttatattgtttctgtagaactaaaagtacattaaatgtactcggaggtaaactacactatgtcatttcgagcaactgtgtttagcgtatgtttgcaacaaagtttagaacacttgggatgttaataaaaatctgatataaaatnggttgaaagacaatataaccatattttaatgataatatataactgatttgtataatccaactaataaaataagtggattanagaaactcgttcanaacaacaccatgtcaacatagtgtagttagcctccgaggcccaaatttttgttccaaacttatcgta

SEQ ID NO: 8366 - DNA, 278 bp, Diabrotica virgifera
  Clone ID: pGUT1530
cagccgctctctcacttcaactctgtaccatccttcaactacaactaaaatgggcactagtgaatctaactcagttgtggatgtaaatatgaaagttcatggtatttcaaacttgagagtatttgatgcaggatcgatgcccaagctagttcgaggtcatccattggcggttatttgggccatggctgataaaatcgctgatgctattaaagataaatatattaataaattggaagtttagaattaaaataaataaaataaataaaatttattcaatt

SEQ ID NO: 8367 - DNA, 232 bp, Diabrotica virgifera
  Clone ID: pGUT1531
gtgattcaaaatgtgagtgaacgtggtccatcatatacacaactttttgtggcaaattgtttccttttaaatgtcttatgacttctggtacaaatttgactgactacagataatacagtggactctctctgtaacgaacacggatactaccaggtttcacttatgacgaagtacagtatatttctcatgaaattcctattgatctataacaactctgtaacgaagcatattt

SEQ ID NO: 8368 - DNA, 322 bp, Diabrotica virgifera
  unsure (1)..(322): unsure at all n locations
  Clone ID: pGUT1532
ggaaaagctggagatgcaggtctcttcatcaaagatcacgcctattaagcaaatcctcacaaatttgttgtgaatgtaacgttattagtgaaaaacatgttttagatctacattgaacaaacccaaattcataaagtctgttatatatattttatctgttatcgtgtatatacaattttgtttagaaatntatacaatatntattgtggactattattttataagtacacgtcgtggttgtactttattttatgaatcaattgttaatttcttaaaacatctatttgtggaagtganattgaaaaataataaataataaatg

SEQ ID NO: 8369 - DNA, 412 bp, Diabrotica virgifera
  unsure (1)..(412): unsure at all n locations
  Clone ID: pGUT154
cttatgcgagttgtattcctactttgtcctattttgaagagtctacaattatttacttaccatttgattaaattagatgaacataagacaatactatatttttatcatgtaagttgatattccctatgtaaattattggcacaatgtaacctccaacttgatttatacatttattttacttttgtgtgtctatgttttctgtaatagagtggaagaattaacattccattaaatgtcattgcccaatgtataaatcaatatacctcttaccattcgatgcttttgcagtatcttaattctagatggtgaacggagatntatcttgatgtaggtnttgagatttacgatgtcactgtaaaaatctaattttatgttaaatatattagtgtacaacaatgtgaatatcactata

SEQ ID NO: 8370 - DNA, 232 bp, Diabrotica virgifera
  unsure (1)..(232): unsure at all n locations
  Clone ID: pGUT1540
attcggcacgagaaccgaagaaggttaccaagaagccacccaagagcgagtcggagtcctccagcgagtccganagtgacgaggacaccaggaaggataagcgcatagtccgaacgaagaagaagccagagaagcgggactcaagcagcancgagagcgaggacgaaatgtcttccananatatanatatcaaaaaaaaaaaaaaaaaccccaagggggggccgggtcccca

SEQ ID NO: 8371 - DNA, 307 bp, Diabrotica virgifera
  unsure (1)..(307): unsure at all n locations
  Clone ID: pGUT1543
ctcgtgccccgaaaaaagcggttatttaaaaacaaaatctttaattttcaactaaaattttagataagtaattgttaatcaataattaaataacttggtaatgtaaaagcccttttcgtatagattataattcctgaagccgatggaaattgagtgaacagtttagcaacaattaaattgttaattanaaattacggtcgctataataacgacnataattatgatgaataagagtaactatgatnntttcataaaaagacactataactatctaatgtactttacagaattgaaatgggactatttg

SEQ ID NO: 8372 - DNA, 421 bp, Diabrotica virgifera
  unsure (1)..(421): unsure at all n locations
  Clone ID: pGUT155
cttatgcgagttgttttcctactttgtcctattttgaagagtctacaattatttacttaccatttgattaaattagatgaacataagacaatactatatttttatcatgtaagttgatattccctatgtaaattattggcacaatgtaacctccaacttgatttatacatttattttacttttgtttgtctattttttctgtaatagagtggaagaattaacattccattaaatgtcattgcccaatgtataaagcaatatacctcttaccattcgatgctttttcagtattttaattctagatggtgaacggagatntttcttgatgtaggtnttgacantttcgatgttactgtaaanatctaattttatgttaaatagattagtgtacaaaaatgtgaataaacactatacatatgtt

SEQ ID NO: 8373 - DNA, 455 bp, Diabrotica virgifera
  unsure (1)..(455): unsure at all n locations
  Clone ID: pGUT1551
tgaaattagtacgtacaatgtctaaaacgattctcattttggttttcgtgtcctgcttcgtagcacatatccaatgtagaatctttatagattgtctagatcctgataatccaggatacctgcaatttgacaaacaaataatagcctcttttcctatgagtatttctgtacattttcctgcaactggatatcaacctgactcagactattcgtgtttaaagataaactgcgataaagatactacagtgacgctaattgacggaggagttggattcaaatatgcaaacattanagttgattttanatcgtggcaaacattaacctgtggaattcaatntatactttacagccagaaatttcatccgtntaaatgacaatctaaattatnnttataaaaaaatgtcccatttcattttctattttgaaattccataatttaaaattattacactatg

SEQ ID NO: 8374 - DNA, 335 bp, Diabrotica virgifera
  Clone ID: pGUT1560
attcggcacgagcgagtttttttttttttttttttttattcaaaaaaaaaaaaatttttttttgtaaaatttaaaaaaaattttttttaaggaaatttcattttttttgggaaaaaatttttttttttttaaaaaaaaaaattttttttttggtccctgttttccgggggtttataactacctctttttttttttttttttcccaattttaaaaaaccaaaaactttactttttttttggtaaaacaatttttaaaaaaattttctgggtagaaaatttttcccccttaaaataaccccctttttttaaaaaaatatcttaatttttttttttcc

SEQ ID NO: 8375 - DNA, 297 bp, Diabrotica virgifera
  unsure (1)..(297): unsure at all n locations
  Clone ID: pGUT1561
gcagcacccaccgaaagtacaactagtagcgtttgccaagaaagtgatcgaaatgagtatatacctgattgccacagattttttgaatgccaaaacaatagatgggtaggtcctttccaatgtccagctgatctttactggagccaagcaaataaacgatgtgtagtactagcgcagtcagattgcaataaacattaacgagagaagatattancacataaaatactttacttgttatattgtaatataatttggtctgttgttataatgagcttaatanaataattactaatatnt

SEQ ID NO: 8376 - DNA, 244 bp, Diabrotica virgifera
  Clone ID: pGUT1562
ctcatgccgaattcggcacaagatgagcaatcataccggtactcacattttgaattatgccttgcgtctagtactaagtacgttatactcactgactaaggcaccgatgctgaccagagaggtacccttgtaaaccagataagttacgttttgactataccaataaaagtgcaatgacgactgatcacatgtatgagactgaggataactctcaacaactcatctccacagttaacgtactctt

SEQ ID NO: 8377 - DNA, 224 bp, Diabrotica virgifera
  Clone ID: pGUT1568
tcgagttttttttttttatttttattttcttttatattttttttttttttctttttttaatattggctgataaaaataaaattttttttttttgggggccccctccaaagcaaatccttttgaaagtaaaaaaaaaaccccccgaggcgtcccgggggttttaccactaaaatttttatttcttaactccgccaaacacaaatgtgtgtgggtgcaccccatta

SEQ ID NO: 8378 - DNA, 320 bp, Diabrotica virgifera
  Clone ID: pGUT1577
gttttattgagcctaatttccttggcacttgttgcttgcgatgattcagttagtacttcgacagacactccggtaatatcaacagaggtaccagcaccgatatcgacaagccttcgtgaagatacagtttacgtagcaacttcaaatgttcccgacccagtcttccagatagatgccgtggaagtattcacagaagctaaggcacttcatccggttgacggtatagctttgttaaaaacattttccgatttgttttacgccaaacaataagtatctggaagatggatagttgctgaaaaatatgattacttttaataatc

SEQ ID NO: 8379 - DNA, 136 bp, Diabrotica virgifera
  Clone ID: pGUT1578
gtgaatcggctccagcgcaaatgaacgtactaatgctgttgtctttattcatgctcaacgttgctctaccgttgctcctcagtagacccgtatgagtcctacaatatggacctgtatctctcttcgagtctatatg

SEQ ID NO: 8380 - DNA, 89 bp, Diabrotica virgifera
  Clone ID: pGUT1581
ctcaaaatacattaccagatatcttttgatacaattcgcagaagtttccgtgacaggatcctatactacatcatggcctcttcttctgt

SEQ ID NO: 8381 - DNA, 316 bp, Diabrotica virgifera
  Clone ID: pGUT1591
gcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcaaatgttaaatgcaaaatcactggtatgggattacttggagaacactatgctctcgctattc

SEQ ID NO: 8382 - DNA, 348 bp, Diabrotica virgifera
  Clone ID: pGUT1593
ctagtctcgagtttttttttttttttttttttgaaataaaaaaaaaaattcccctggggaaaaccaccttttttttttggaaaattccatcccaaaaaaaaaaatggaaaccccattttggattaaattttaaaatggggtttccccccaaattattaatttctttccaattttaaaattttaccaaaaccaattttaaaccggttttaacccgggggggtcccacccttaatttaaaaaaaatttttcccccaaagggagcaccctttttaaaattttttttatttttaaaataattttcaaaaaaaaaaaaaaacacctcgggggggggccgggtcccactccccc

SEQ ID NO: 8383 - DNA, 268 bp, Diabrotica virgifera
  unsure (1)..(268): unsure at all n locations
  Clone ID: pGUT1595
aaatgagctatcgacctgttagtaggactaagaacttgcatccatttaaatgctataatccttcttccacgcgaacagaagataaggtttctttaggattacaatttttaagtgtgacatttaatttaatatttactttattccataaaatgcttagagcttcagagattgtctcacaggccaaatgaaatgtcaatgaaaattgacatgtgacagaacataaaacacttatacnaaaaaaaaaaaaaaaaaaaaacctcaggggggg

SEQ ID NO: 8384 - DNA, 302 bp, Diabrotica virgifera
  Clone ID: pGUT1596
aaaagtcctctacgactgtgaatgacaatggaaaagtcacaacgtatgaagctcacaatccataagaaaataattttaataattattaatgaaaaattaaaattattttcttgtttattcaatattttgttcgtttatttgaattaattttttatccagtatacccaataaaaaatatctacatatatagtttcagtatttaaattataaataggcgatattttgtgtgtataataaaagtaatttctaataaatagtttccattcattgcacaaatttaaggaattactgataggctatca

SEQ ID NO: 8385 - DNA, 272 bp, Diabrotica virgifera
  Clone ID: pGUT1602
gtaaatatggatactcttgatatattcttgttgctttttttcatatgttctataattaattacgtaataagtgttttcatcaattactggaccctgaaaaccattcctcctgaacaaacacggagcaagtattatatatttaattgtttgagtaacgccagtaccacttactgtatccacgaccacctccaaaagatagttaagcttctaagtattcttgcaaggcaaaatactactgcttggatatcaccactggattcccagttaaaact

SEQ ID NO: 8386 - DNA, 390 bp, Diabrotica virgifera
  unsure (1)..(390): unsure at all n locations
  Clone ID: pGUT1603
gatctgttctcctaccaagtgaaaaatctactgaaattacattaagcggagctgctagtatctacgctgacaacagagtttcttcggtcccattggtcgattttagcacagacggtcaagttagagcaagtgataaagatggagatcttaaagcaaatcttaaaacaaacaaacttgaccccatttctgtggttgccggatatagctgtaaagatctagggcaagaaaaacatcaagtaactggtaacgtanccttgcagtacagtanaggcaaaaacttganattagatggaactcttacaaaactcgcaanacatcaatacaaattggaagcaaatcttgacactccattcgaagccttgaaaaagattcatttattgggttgaaact

SEQ ID NO: 8387 - DNA, 320 bp, Diabrotica virgifera
  Clone ID: pGUT1605
ctcgtgccgaatcggcacgagataaaaaccgccgaacacagagctttcccgaaagcgttaaaacttctggcctcggataaaattagattaggagacgataataaaattatctggtcttgagatgttgttatgaaataaacttttactagtctcgagttttttttttaatttccattttttatttatttaataatttaaactattttaactttaattataaaccaaaatattttaaaactaaaaaaactaatttaaaattcaattgaaaatgataataaatttattttcttctttcgaccctacatctaattttaatttac

SEQ ID NO: 8388 - DNA, 309 bp, Diabrotica virgifera
  unsure (1)..(309): unsure at all n locations
  Clone ID: pGUT161
atttaaaggtactcacatcattttggagggttccaacgtcgagaaactcgacggtaaacctaagatgaacggacaagttgtcaatgctagcagcaaggaagatatttataatcaaacctttcaatgggaaattgtatgcatagagtgttgagtctgcaatgtcagataagtctcacattgactgtggatcagtacgacgcaacgattcccataggagatccatttccggagccagcaaaagtattgaacaatctgatattgaaagtatctctttagctagtcccgatgcnttttcattattttaattct

SEQ ID NO: 8389 - DNA, 339 bp, Diabrotica virgifera
  unsure (1)..(339): unsure at all n locations
  Clone ID: pGUT1612
aacaatcaaaattaacatgaaaactcaaaaatcaataataaaaagaaaacaaaatttagtacacacgaagtactctttggtagatttgtggctgtctcaagctcaactgttgttcttgagaaaccaattggttaagtgctgattgttggggcaaaactcctctttggagtaataatacaacttgctgatggatcagttgttgttgagcgattaattcttgaggaacaagatctccttgctgaaccaattggaacaattgtttgtagatcangaagttactgganacaagttgttggggatcaacacgaccttgttgaacaanaacttgatctaattgtc

SEQ ID NO: 8390 - DNA, 94 bp, Diabrotica virgifera
  Clone ID: pGUT1613
taaaccaaaatacctcaatttttaacaaaaaggtctgcacactgcccgttaccttcctaaattatcaaagtggcggtttgagaaagagagaaag

SEQ ID NO: 8391 - DNA, 83 bp, Diabrotica virgifera
  Clone ID: pGUT1615
caacttggttattccaacctccaaggtgtcaacaaccaaggtgtctaccaggctgatgttcttgcttcatcaatttgcagagt

SEQ ID NO: 8392 - DNA, 312 bp, Diabrotica virgifera
  Clone ID: pGUT162
atcttgaagtgtcaataaggactgtgtgagtgattatgaccagaatacagaaagacagagctttcagacacggattttacatctccagtatggataattttaaagcaaaagcgaaagttcttataatatctcttttatttatatctgtcgactcgggaacaagttttggatggtgaggttgatatcctcagattatctactctagttaaggggaattaatcacaattttatattgacgctccgattttcacttaaaaattgtgtcccaaatacataaaatgttatgaatctcaattaaaattttgattaatt

SEQ ID NO: 8393 - DNA, 251 bp, Diabrotica virgifera
  Clone ID: pGUT1620
ctcgagttttttttttattttttttttgggtcaaaaatttattttaaactttgaaatttaacccgaattcccaattaatttgtccccaaaaatttcaaaaagggtggtttttccaaggggaaacccccccgcaatcgggggttttttttttaaaaggggggaaaccatttatccctggaaaaatcccccatttgaaccgggaaagccatgccccccccccctagtaattcctcaatttccgccaaggggaa

SEQ ID NO: 8394 - DNA, 272 bp, Diabrotica virgifera
  Clone ID: pGUT1621
ctcgtgccgattcggacaccagcgagttttttttttttttttttttttttaaaaaaaatttaaacaccttggtttcccccaaattttttctaattttggggcctccccctttccccccacgggggtcaaaatctaaaaaggggcctaaaatttttaaattccccccccaaaacaaatgccttggaattccccaattaaaaattcccacctaaaaccccctccccctttaccaaaaccttttcgggaacggaacattccggtttgggaacccc

SEQ ID NO: 8395 - DNA, 272 bp, Diabrotica virgifera
  Clone ID: pGUT1623
gtcctacctatcccttgcgtcgcctcctgagtcccggacgatgtgagctatgtcgactccgtccccgcatgcgctccaactgatgcgagctatgtggacacgttgacctgttcctccccatctggagctatctatgcagacgactctgaccgaccgaacttctttggccctcactacatcatatcctccgagtggcggggcttcgccacccatcttgccatctaagacttagactgaccacgcttcgacacacttttcggtggcttgtctga

SEQ ID NO: 8396 - DNA, 355 bp, Diabrotica virgifera
  Clone ID: pGUT1626
cacaggactccccgcggtggcggtcgctctataacgaatcgcatcccgcgggctgaatgaagcccgaattagctaaaacataacaagtatgtcctgatctgataatcatcagcttggaacgtcgatagttaccaccccgtgtcaagcaacatctttcgtgacgtgtagcactactacaacccagtattgtccagataatcttggctgacctcaccgaggaggtgcccccgtgcacatgtccacccatccatgctcccaatttttcgtcgggggcggcgtggtaaacgcgcatttctggttccctcagtttgatcggtgttgtgtcacctacagcgccaaatgcgcggtgtattgt

SEQ ID NO: 8397 - DNA, 265 bp, Diabrotica virgifera
  unsure (1)..(265): unsure at all n locations
  Clone ID: pGUT1627
tttgacgatatatttcaggtaatttctggttggtataacctgatcctgaatggccagtaatgaaccctccgtttcagggaacatctttcctgatgtcaaccaatagttcgacgctgtattgtcgacatagtcttggctgacctcattgggatgtcgcccgtgcagaggtttacccatccaggcgcgcagtttttcgtccttaataaagtggtntaagcgcatntctggttccctcagtntgatcggtgttgtgtcatctactgcg

SEQ ID NO: 8398 - DNA, 473 bp, Diabrotica virgifera
  unsure (1)..(473): unsure at all n locations
  Clone ID: pGUT163
atcttgaagtgtcaataaggactgtttgaaagattatgaccagaatacagaaatacagagctttcagacacagattttacatctccagtatggaaaattttaaagcaaaagcgaaagttcttataatttttcttttatttttttctgtcgactcgggaacaagttttggatggtgaggttgatatccacagattatctactctagttaaggggaattaatcacaattttatattgacgcttcgattttcacttaaaaattgtttccaaaatacataaaatgttatgaatttcaattaaaattttgattaattcccattanataaaatagataacataggattcacacagaanatagtttcagcaccacatcgaaagatatttaccgaataattcagtttattaatatttaaaacaatagatcttaaaaccaattattaataaattgcaaaaaaaaaaaaaaacccaagggggg

SEQ ID NO: 8399 - DNA, 194 bp, Diabrotica virgifera
  Clone ID: pGUT1631
agcccatctgcctccaagtttatcatcactatgattattgccaccctctctcacggagtatggcggccgactcaacaagagtacctccttgccttcggattattttacacacgactgtgatattactccgtctggcatcaatagggtatgtctatatgcagggcgggtatctacattttctgctccgatgacat

SEQ ID NO: 8400 - DNA, 168 bp, Diabrotica virgifera
  Clone ID: pGUT1633
atttgcattacaaaaatcaagtgcttcgacaagatacccttaaaaatcaagtcaatcaacaatataactacaataacaaagtcgcacagcgttattggtcatctcactatagtccatcattgttttcaaatttatatctacacagctacagtagtaatcaattatatc

SEQ ID NO: 8401 - DNA, 208 bp, Diabrotica virgifera
  Clone ID: pGUT1635
ggaaactgctctaccaggtacaacaccctgccaggtacgtaagtcgtctacagacaattccgagttccaacatcgaaaagattataatacccatgttcgtccgtctaaagatctggtctactggcaaggatcgatcccaccgtaaaccgataatctcaacggaaataagggctcgtgcgacagtcgtaacgaactacgattggctagt

SEQ ID NO: 8402 - DNA, 154 bp, Diabrotica virgifera
  Clone ID: pGUT1636
ctagtacagaattccacgtctatcttatcgacacgttcgtaccttcagtttagattattcctatttctaacttctagggcattatgtactcatgttcgtccgtctaaagatctagtccaccggccaggatctatcccggtgtaaacccatattc

SEQ ID NO: 8403 - DNA, 218 bp, Diabrotica virgifera
  unsure (1)..(218): unsure at all n locations
  Clone ID: pGUT1641
ctcgagttttttttgttgtctatgttaattcgatgtaaagttaacttaaatgaatctacataaagtagatttctagtttctgggcaccaaaaaggtccttccgcatgctgtactgctgtggttactttttcaatgacatacgtgtagcaacagttaaaaaacaaagtatataatataatagtagttatttntaaaagccgcataatgttggtctgggt

SEQ ID NO: 8404 - DNA, 291 bp, Diabrotica virgifera
  unsure (1)..(291): unsure at all n locations
  Clone ID: pGUT1642
gtttgatttctatcagaatgctaacaatccaagaatgcatttcgaccaagtccaatgccctgctgaaatcgttgcccgatctggttgcagtctttaaatataatataattttttgttttaaaacaattatattttacttaggtatatactaaaataaaacttaatttttgaatgtcaaaaanaaccncnncnaaaaaaccacaaaaaatacgtctngccgttccggatcgtnagtaccagttttcncaaatannnttttttggggggggggggggggcagccccccccccc

SEQ ID NO: 8405 - DNA, 233 bp, Diabrotica virgifera
  Clone ID: pGUT1643
attttataggcgatattatcaacagcactctaaatggggccatttctaaaatgtctgatcccatgacaattgctgatatacacatggaccagaactctgaggctctagccggaaccattgatattaaagacattgctatctctggtatacataaaatagtatccactgccgtatcaaccaacctcatcacgcaacaactgaacatatcagttttgggtccctgatcttactat

SEQ ID NO: 8406 - DNA, 207 bp, Diabrotica virgifera
  unsure (1)..(207): unsure at all n locations
  Clone ID: pGUT1649
tcgaaccaaaatggcaaaaatcgtcctcttcttctgcgccatcattttggcttcagcagctgctttaccaacccaatcagctaaaggaggtgttgtcgatatcatcaaaaaggtcgtgcacaagcttgaagacgtaatggaaaaggtgtatactgaaggtcncaatttcatccacactttccctgaaaagtatgacgaacacttact

SEQ ID NO: 8407 - DNA, 317 bp, Diabrotica virgifera
  Clone ID: pGUT165
gtgaattattccaacatggaaccgttagcaataataattcctgtatattcagtagttttgttaatgctccttttacagattctatgggcgtttaaaatcaagaaaaaattgtacaaaatgatcgatgaaggttactactttttggagttggaaacaggctggggaaggataattttgaaacctattcctccaggcaacgtagatttatcatccggctctccgagactgatcagcaacatcataattcgccaatgatatcgccgaaaatgttaacgaattttggaaatcatggaaattgttaatacttaagtagatac

SEQ ID NO: 8408 - DNA, 187 bp, Diabrotica virgifera
  Clone ID: pGUT1654
gtatagtaactttttttattcgtagacattttattcatagattttacctaaaataacgtaaaatcaacaatagtaagtgtcaatacacattaataagtagtatatggaggtcttgcatatttcctatacaaattgttccaaaacacaattttgtcagaattgggaagacctttcaccgtaagatcat

SEQ ID NO: 8409 - DNA, 225 bp, Diabrotica virgifera
  unsure (1)..(225): unsure at all n locations
  Clone ID: pGUT1659
atagagtacaaggaaggagcttcaatcaacaatggttgaacaattccccagtccaatctttgcagaccatcttgcaacagatccagcaacaacgtggacttcaacaagaattattgggacaataccaaaacttgccccaacaatatttgaacgctgaatatctccaaaaccaagacattnggtacaaccaaatcttaaacctcatctacagacaacaacaacaac

SEQ ID NO: 8410 - DNA, 238 bp, Diabrotica virgifera
  unsure (1)..(238): unsure at all n locations
  Clone ID: pGUT1661
gatttggttacagcagtggttaccgagcttgctattctgccttgtacaagtgtaccagtagttttgagaattatcgctacagaaactacctaaagactttttactgttttattgtattaaccgagtttattttttctgattaaatgtgtaatanaaaacgaagtttanataaaactggatggattgcgtacttgattggacaattatctctcctccagtnatccatcctcaatatctc

SEQ ID NO: 8411 - DNA, 215 bp, Diabrotica virgifera
  unsure (1)..(215): unsure at all n locations
  Clone ID: pGUT1662
ggacgccaaagaggtcagtagaattcctcaagaaagttatgaccacaaggtgcgttacagatgtttgtgaagactattaataagtagaaagaaattgtttgtaaatatgaatgttggatttctgttattcagattcaattttttcagattaacaactaatttnttgttacttcttgtaccctttcaaacgggctctgatctggagggcgaattgt

SEQ ID NO: 8412 - DNA, 150 bp, Diabrotica virgifera
  Clone ID: pGUT1664
tgtaattctgaactttacgtcatgtaagtactcacttaacgtaaaggatacagcgtaccccccaataataaataactaatagatgttccatgggccaaaatattcactgacgaaaatctaacttaccatgaccgtcgtatccagaaaatc

SEQ ID NO: 8413 - DNA, 251 bp, Diabrotica virgifera
  unsure (1)..(251): unsure at all n locations
  Clone ID: pGUT1667
ctggaaaggactcttacgaactcagatacttccagatcgacagtcgagaagacgatgatgaagaagataatgaataatttattcagttatttttttattaaatagattatnnnnnanancnnnnnannnnnnnnnnnnnnnnncccccnncnccnncnncnccncnnnnnnnnnnnnnnnnngggggggggggcggggggggccnccccccccccccttttttttttttttttccgggggggggggggctt

SEQ ID NO: 8414 - DNA, 237 bp, Diabrotica virgifera
  Clone ID: pGUT167
aatgtaactttgtaccttttttttcacatatcaataatgatataaatatgttacatatggatatggcgattataataaacgaacgaatgtttaattttgtgatcttccttttgtaatacgtacgtgcatttacaaattatttttttaagtgcaattgttcaaagagaactactgttaattaagttatttaagattgcacgaaacgcaggatatgttattaatacatcatgattattg

SEQ ID NO: 8415 - DNA, 401 bp, Diabrotica virgifera
  Clone ID: pGUT1672
tcgagttttttttttttttttttttttttgggaaacccccccaaattttcccccttaaaatttgggggcaaaaaaaaaaattaaaaattttcccaccccggaatttaaaaaacccccccaaaaaaaaaaacccacccttccccaaattcccctattttttccaaaaaataacccccccccgggtgaaataccccccccctttataaaaactttttgggggggaaaaatcccctggaaaaaaaaacccccccatttttttttccccccccaaacaaaaaaaggtcttttttccccttcacaaacttggccaagggtaaagggcccctccaaaaattttggggcccggttaaaaaaaatttttttttaccccccgttttgggccccaaaaaaaattttttttt

SEQ ID NO: 8416 - DNA, 211 bp, Diabrotica virgifera
  Clone ID: pGUT1674
aacaccgtatctatcattgtgaaattaggtgtgaaaggtgtttaaaaatgaggttccttattctacttgccgtattggctgtagctgtgaatgctacatcaatccaccaacaatgggctacatttaaggtaaaccattccaagaagtacggacatcttaaagaaaagcaagttcgcttccaagttttctctcaaaatctccgcaaaattga

SEQ ID NO: 8417 - DNA, 62 bp, Diabrotica virgifera
  Clone ID: pGUT1678
ccccggcctgaaggattccggaccaagcttcttcccaaatccggaccaagtttttttttttt

SEQ ID NO: 8418 - DNA, 263 bp, Diabrotica virgifera
  unsure (1)..(263): unsure at all n locations
  Clone ID: pGUT168
gaagatttgcagataaatgtagtttcagatacatgttggcttcatgtactgctttggctgttaggatgtagctggtttgatgtaagcttcataatgtaagctgaagttgtatttttcaggtatatgctgtcatcttcatggtccaatgcgtagtgtaccacgtggtttgcgtgtcccaccaaaaaaaaggtcaagacggattcaaatcaaaacaggagacattgtgctagcgacagtataaatnttaatagcatagaatatgg

SEQ ID NO: 8419 - DNA, 327 bp, Diabrotica virgifera
  Clone ID: pGUT1682
caagctcctgccaaatcggacaaccaatatatccaggtgcgcaattgtctgtcagtgtctgcctaataaaaaaggtgcgttgacttaccgttagggaaaataattttttgggcttacaaaccaaagcgtttgttcttcaaatcggtgtcaagcgctccaataaagctagcttatttgccgattgttgcagtatttttttgaaagtatgtaatcaatttaaatcatatcttttgtattaaaaaaataaaagtacatatgtgccattaaaggacacgtatggtcaaaaataacttccgtattgcaaaagatggtcggatctgtcacacg

SEQ ID NO: 8420 - DNA, 471 bp, Diabrotica virgifera
  unsure (1)..(471): unsure at all n locations
  Clone ID: pGUT1698
cctcgtacgccagtcacgagaaaatttgtatttgggtgcccccacatttcaagggtgctggattctccgttgtacaatctacatgtttgaccacgaatttatcgtacgaccctcgtattatgcgattaaaaaccaaaaaaacagtaaaacaaacgttctaaaaaatttctagagctttcgaaccccttggtactgaattatattatttatgactgtaaacacgaagcgaagataagactcgttactaactactgatacgtgtcatgaaatgtcaaggccactatttttagttccaaataaatattatattgttaagaaatttttaacttccagaaataatttaacanattaacaggtagtttattgttatttatagttaagtattaattgaaagctacgtcacgattattttgtgcaatggtttcccatgttcatttattcacaagattcgtggtataaaagattttaatt

SEQ ID NO: 8421 - DNA, 122 bp, Diabrotica virgifera
  unsure (1)..(122): unsure at all n locations
  Clone ID: pGUT171
caggcgatgtcgattttttaaaggaattgcgcaaacaaagactaaatggtgaaaaataaaattatttaaaaatgtgtttctctcgttttagcgaanaaaaaaataaaaaaaaaaaaagttca

SEQ ID NO: 8422 - DNA, 322 bp, Diabrotica virgifera
  unsure (1)..(322): unsure at all n locations
  Clone ID: pGUT1713
aaaaaaaaattgccgggccttaaaaggagtgaaaaaccagttagggctttttcttacaataatacaccatgatatgtggctcaataatacaatgcaaaagattgtaaatggagttacagttaaaaataaagtttgcgatttccaaatgtgtgaagtcaattctcctacgatcgatctaatgctcttcctttttagcagtgtagaattacgctgtcttgaaataatgtagataacttaatcannatctatcacgaagaaacttgtaatatattgaaaaaactaaacgtatacagcgaagaatattgtataaaaaacttttgga

SEQ ID NO: 8423 - DNA, 218 bp, Diabrotica virgifera
  Clone ID: pGUT1723
gtgaatccaaaattgagtcaaccgtgttcaacaaaaggcgcaacttttgggggcaaagggctcccttttaaagggcatttaacttccggtccaaatttgactaactaaagaaactacaggggactctctctgtaacgaacacggatattacgagggttcgcttatgacgatgcacactatatttctcatgaaagtcctattgaactataacacctctg

SEQ ID NO: 8424 - DNA, 342 bp, Diabrotica virgifera
  unsure (1)..(342): unsure at all n locations
  Clone ID: pGUT1724
ctctgcccaaattcgcacgagggaaaagctggaaatgcacggtcttttcatcaaggaggacgcctattaagcaaatcctcacaaatttgttgggaatgtaacgttattagtgaaaaacatgttttagatctacattgaacaaacccaaattcataaaggctggtatatatattttatctggtatcgtgtatatacaattttgtttagaaatttatacaatatttattgtggactattattttataggtacacgtcgtggttgtactttattntatgaatcaattgttaatttcttagaacatctatttgtggagtgaaattgaaaaataataaataataaat

SEQ ID NO: 8425 - DNA, 238 bp, Diabrotica virgifera
  Clone ID: pGUT173
cccatcgaaaaatcgatgttaagacactatgaaacagagctagaagtataaatatacgacggatatgctaggtggagagcatcacacactgggtcagaaatagaggactagaatgaaacgatcacatgggcggaatgacaacaaatagacaatttcccaatagaaagacgatcagggggtagaccacgaaaacgatgggacgacgacttactgaaagcacatcgaaaaccagtcacct

SEQ ID NO: 8426 - DNA, 285 bp, Diabrotica virgifera
  unsure (1)..(285): unsure at all n locations
  Clone ID: pGUT1735
ctcgtgccccgaaaaaagcggttatttaaaaacaggatctttaattttcaactaggaggttagataagtaattgttaatcaataattaaataacttggtaatgtaaaagcccttttcgtatagattataattcctgaagccgatggaaattgagtgaacagtttagcaacaattaaattgttaattaaaaattacggtcgctataataacgacnataattatgatgaataagaataactatgattntttcataaaaagacactataactatctaatgtactttac

SEQ ID NO: 8427 - DNA, 347 bp, Diabrotica virgifera
  unsure (1)..(347): unsure at all n locations
  Clone ID: pGUT1743
tgaaattagtacgtacaatgtctaaaacgattctcattttggttttcgtgtgctgcttcgtagcacatagtgcaatgtanaatctttatagattgtctagatcctgataatccaggatacctgcaatttgacaaacaaataatagcctcttttcctatgagtatttctgtacattttcctgcaactggatatcaacctgactcagactattcgtgtttaaagataaactgcgataaagatactacagtgacgctaattgacggaggagttggattcagatatgcaaacattaaagttgattttaaatcgtggcanacattaacctgtngaatcanatttatacttta

SEQ ID NO: 8428 - DNA, 280 bp, Diabrotica virgifera
  Clone ID: pGUT1759
cggaccagaatccggcccaagggaaaccaaaaccagaaaaccaggaggttgaagttttcggtaatttgagtctttgacagtatcatgggcgctttctagtactcacaatgaagtttataaactgggaaatactaatcacgcgcttaagatcattaatggaaacccagctaaaccacatcaatttccctatcaggtaggagtgtacgtgtatacttcttccagatccgatttctgtggaggttcgcttatatctcctaactatgttcttactgcagctcat

SEQ ID NO: 8429 - DNA, 277 bp, Diabrotica virgifera
  Clone ID: pGUT176
atagaagtcagtgaaaaagtgcaatgaaattattcgtcctcgccctattggcaggtgcggcaacactatccttgtgtaaccccttcgaggggttggaatatgatagatggacacgatccctgctgacagacgccgataccagccacaccggaggcgataagatatcccaaaggtcttcacttactgaagccgatgctggactacctgatggtgacagaatatcccaacgatctctcttcactgaagctgatcctgcgctgcctggtttcgaccgaat

SEQ ID NO: 8430 - DNA, 225 bp, Diabrotica virgifera
  Clone ID: pGUT1763
caagaccttcctatttttcaatggaggttttccacaatagggttgcttaaattgcttgctgaaggaaacacaaaaagtgcttgttaactgggctgccttaaacgaaaaggtccctgaacatcagcgtgcccaggtttttagcgttcaaaaactaagtccgacagctatcttaagcgtgtcttagcaaatcctgaacaagccccagccattgattgggcttactat

SEQ ID NO: 8431 - DNA, 379 bp, Diabrotica virgifera
  Clone ID: pGUT1769
tcgcaccaacctgcccaaatccgcaccgaggtttatttaaccctaggttccttgcaccttgtgcctggcaataatccatttataccttcaacaaaccttccggtattatcaacagaggtaccagccccgatatcgacaagccttcgtgaagatacagtttacgtagcaacttcaaatgttcccgacccagtcttccagatagatgccgtggaagtattcaaagaagctaaggcacttcatccggttgacggtataactttgttagaaacattttccgatttgttttacgccaaacataaagtatctggaggatggaaaagtgctgaaaaatatgagtacttttataatccacatataaactacgtgtatattgaattga

SEQ ID NO: 8432 - DNA, 401 bp, Diabrotica virgifera
  Clone ID: pGUT177
gcaaaaatggaaaataagcttttcctttgaccgccgaaagatccatagtcggaaatgactctcgctttatcaattaacatttgagaaagaggtgcgtgcgctattcacattaaacggaactctgatcttttcggtttgattcacttgtaaacactgaccatcgtatcatgccgcagtcttatttaataatagatgattggaaatctctcagtgactgcataatctgacggaattagaaaaacactgtgggtgcatgtgtacattcttttattaattacgtaaatgttgcgcttgtgatgtgatggacgcttaagctcttaagccggtgctttcttttggagctttgccctcagcctcagatacaatactcatatttaattatttttttttaacaatttata

SEQ ID NO: 8433 - DNA, 232 bp, Diabrotica virgifera
  Clone ID: pGUT178
aatccgaagatacgctcgcgtccgctcttgctatcctaggtccagtttccatcatctgttgatgctgatacctcgcaattatacggaggtggacttttcaacaagtaagactgtagatccaacctcaatcatcgtgtacttgctgtgggatacactaaagatgcctccgttgtccagatctcgtggggaactaactggggtgaacaaggttgcatctcactcgcccgtggtg

SEQ ID NO: 8434 - DNA, 322 bp, Diabrotica virgifera
  unsure (1)..(322): unsure at all n locations
  Clone ID: pGUT1783
ttctgtgcgaacaacaattcaactgggtaccatgtcacggcggtaacattccaccacacgcagtggaaggaggtagaacgtccgatggagaacctttatacattggcagatcttaccacgaaggttcccaaacagtacgaaaggttcacccaagtcacggttgttgctacgtaccattcagcggaggcgaacacagccattccaactatgaaatcttggttctcacgcattaaatatttattttttaagtcatttatttttacataaaacatttacacacatccntttcataaaaaataaatatcacacccccagggggggc

SEQ ID NO: 8435 - DNA, 121 bp, Diabrotica virgifera
  Clone ID: pGUT1785
gtcctgaatccagcacgatcctgcgaggtgctaccgtctattgtagaaaacaaaccctaccacgcaattcattgctgtaaaagtgtcccagatccaccaatccgtatttgcgaattgggtt

SEQ ID NO: 8436 - DNA, 194 bp, Diabrotica virgifera
  Clone ID: pGUT1789
actcgtgccgaacgtattttacagaattaccaccactttatcaaacggtattattccagtttgaaaaaatttcttactattttagaagtgatttcttaaagcaattgatgtatttcttataattaactcaataatattatttcaaatatgatacaagtatactattgactgagcctattcctttttgacaccca

SEQ ID NO: 8437 - DNA, 273 bp, Diabrotica virgifera
  unsure (1)..(273): unsure at all n locations
  Clone ID: pGUT1797
agccgtctttgtagccgttttggctacccaagaagtcagcgccggtgctgtcaaaggtgcagaagctcctcgtgctgctggacttggagcaaactgcgaatgtaacgcatgcagtaaagaatgcacatccgagagctccgactacattggaggtatttgtgaccaaggccaatgtgtatgtgcctcccttggctaaactaaataatgtgataaagtgtaattaataaagtgttaacttganaaaaataaaactccagcaaaaaatcctttttt

SEQ ID NO: 8438 - DNA, 283 bp, Diabrotica virgifera
  Clone ID: pGUT1798
gaaaaatgataaatttgacgatatcgtaaaatctttagccggtagtaaaaagaaacacacgaagaagatcagtctggtagaaattgctctaaatagtgagcgtgattccaatcagaccattcagagtttagacaagtcagagctcaccaaaagatagcgaaaactgaaacagagcttcttatacgtcagctaccgagtaaagatactaaaagtcgatagttggacagaataatgtccagttattgagaaaagtaaatctcctggccaaagtccttttttagac

SEQ ID NO: 8439 - DNA, 349 bp, Diabrotica virgifera
  Clone ID: pGUT180
gaaacacttccattgaggcctatatatcatcagaattggcatatgatagttcatggccctctttgccatcaagaagattatttccctatacattggattatcaatcaacagaacaatgtcttttgggcgcagaatgtcctaacgaagctttcccaggttattggattctgccaataaacgatttaacttcaccaaatggtagagaatgcaattcactggctacttgtggaatagaaagtagtgttgatcaaatcgccaaatatttggatgatcaaattgaaggaggtagaagtaaatctagaactcccacacttttgatgatcaactcatactggtttgatcaaactga

SEQ ID NO: 8440 - DNA, 187 bp, Diabrotica virgifera
  Clone ID: pGUT1809
gaatctgatactaatgtatctaaagatattgaagaaccaatctcaatcgacaatgagaaagtaagtgaggctgttaaaactaaagaaattaaagagactgatgttgaagctgttacagatcagaaaaacgtagtactccttgaaactgttgatgaggttcatgccgaatccctattgaagaatctgg

SEQ ID NO: 8441 - DNA, 303 bp, Diabrotica virgifera
  Clone ID: pGUT1812
gtcgtgcacactgctggaactatcgtgcacaggtaggatcatcctggtaaattacgaaaaatcgtgtactctgaaagaactttctcgataaggatcatcgactttgatggtgtgctcacatcactctggtgtgatcagatcgtcctctacgtgtaaaccttgtacactttccgagagctttgagagtttccgaatgcggtaagtgctatatagtcatgtatccggcaaacatcactaagtcacgcgaccctctcaagggggggccgggaaccccggggggggccgggtaccccctccccccaa

SEQ ID NO: 8442 - DNA, 272 bp, Diabrotica virgifera
  unsure (1)..(272): unsure at all n locations
  Clone ID: pGUT1813
agaaaatgaaaattgccaaagataaaacagaacttactaagaaagctttgaagctggcacttaagtactcgtttgttactgaggtgacatcattggttgtagtgaaacccaactctacacgttccatatatgcagatgacggatatcttcgaagttgaagacaaaaatattcgaccccggcttttcacgcatacggaagaagtggacaacctgctggaggtcaacacaaagtancatactccgccgtctcatccagttcattcgtaagcaac

SEQ ID NO: 8443 - DNA, 208 bp, Diabrotica virgifera
  unsure (1)..(208): unsure at all n locations
  Clone ID: pGUT1815
acatgacgatgagaacacaaatgatgaccgaacaaggagttccacaaacaatgaacgataaaatggtggccctcaaaatgatgattaataataacataatgagagataaaatgatgaaacgtgacatgatgaactnaaaatgttggaagaacaatgatancccacaattagtgatgacaagaaaatgatggctcaaaaacaagtaccc

SEQ ID NO: 8444 - DNA, 165 bp, Diabrotica virgifera
  Clone ID: pGUT1816
caatcaaagtattttattttatttttcataaacttgagtgttatacagtttttttaacaactcacagcttataacccttattgactgtgataaaccactatgtgataaggatcaaaataacttttgaatgtcttgatttgtgtttagagtcttcaacatggataa

SEQ ID NO: 8445 - DNA, 337 bp, Diabrotica virgifera
  unsure (1)..(337): unsure at all n locations
  Clone ID: pGUT1817
cggtgtcagtagtgacagccgccatggggctctgcatattcgtcacaacctcatcctatcccttcatggaagagatgttaggaatacattggtgcgtttggatttactgctgcgtctgcttcatcggtgctacctttatatactttatgatacccgaaactaggggataaatataccaaagttacaagagtacctgagaactagaaaaatgtgattatnatgtttcgtattcggcaatttgtacttttgtataaattttgttttagtacttaaaaaccgacgataatatntatgtagatatacgtctttttataaaaaaaaaaaaaaaaaaacccca

SEQ ID NO: 8446 - DNA, 144 bp, Diabrotica virgifera
  Clone ID: pGUT182
caacagaaaggtcttattaaacaagttgtacaacacagagcacaacttatttacactaggaccacaaagggagatgatccagcggcatacataataagatacacatatatctttataaaaaaataaattttaaaatttatacct

SEQ ID NO: 8447 - DNA, 241 bp, Diabrotica virgifera
  Clone ID: pGUT1832
cccccaaaattttaaaaagtaaaaatttttttttaaaagtaaaaaaaatagccgggggggcacccccccttaaataaggggtggaaacacccgaactccccaaaatttcccccccccccgaatgcaaaatttttttttggaattcccccccatctggggggagaattttttccccccaatttaaaaaaaggggggtttttcctttttcttccaaaaaaatgacccccaaaatttttttttc

SEQ ID NO: 8448 - DNA, 143 bp, Diabrotica virgifera
  unsure (1)..(143): unsure at all n locations
  Clone ID: pGUT1835
tgtgaaatatgttttgtgtcttataagagtatttattttaaatattaaaaatctcttctggtttcataaaaggtatttttgacaaaatgaaggtagctgtaattggagcatgtgcatctggagtttcctcagcanaacacatc

SEQ ID NO: 8449 - DNA, 266 bp, Diabrotica virgifera
  unsure (1)..(266): unsure at all n locations
  Clone ID: pGUT1836
aaactgttatacatgccaaagctaattagatcactaataagaagtattcataattttctttaccgaaagtttcagggaggattcttcatcgatcatctgcttttctttaagatgttctaataaagaatttaaggtattcacttttttaataagccttctanttcgttgttgcaacantttgatttgtttagttttcttgtgaatgaatttgtttactactactttatatccttggtcaggaccgcgtgtaagtcaattgacgccct

SEQ ID NO: 8450 - DNA, 222 bp, Diabrotica virgifera
  unsure (1)..(222): unsure at all n locations
  Clone ID: pGUT1838
gtaacccttagtgtcgctgcatactacccaagtactggtaggcaggtgacagtaggagtatctggaaatgtgaaactagtcggctctcaaggttcccagattgacattcgtaaaagtccttacaacccaagaactgtcgacgtcaccctcagaaatccanatgctccacccagaactctgcaaattgataaacccaggaacggccaacaacttggttattcc

SEQ ID NO: 8451 - DNA, 344 bp, Diabrotica virgifera
  Clone ID: pGUT184
gttttatttcttgttatttcttttttatttttttatttgtctttaaaaatttatatttttattgcactgatccctttgaatcttaggttctaataagtaaataattttttaatataacattttatttccatatgtagatataaataaaaatatacatatacaaaacttatagttagagtatttaaaggtcttgttgtacggacaggtatatatttaaaaaaatctacaaaaatttttcgaaactatcaaatgtgtgcactatagtcaaaactttcgcagttattttttttaataatgtggtgttcacgaatttaaaacttcaccttattttaaatggcttactt

SEQ ID NO: 8452 - DNA, 274 bp, Diabrotica virgifera
  unsure (1)..(274): unsure at all n locations
  Clone ID: pGUT1848
aatagtcgccgcttcaaaaatacgctaaattcattgttttatctattgttacgataggagacctcatatattcttacctagaccggctctgaccatcctacttatcattaaactacctcacttctgacaccagtgttacgtttttactanatntatntaacagtggtgtcaaaattggagtcgtttactgtcaagtcaggattgtcanagcagacccagttaagatcatgtgcggttgactatcgtaacactactttcgcccacaaaaatactg

SEQ ID NO: 8453 - DNA, 271 bp, Diabrotica virgifera
  Clone ID: pGUT185
atcaatatgtagttataagatcattatcggcggtaatatatctctaattgtgcctcgacatttgctaatctattcgccagtctttcgtatccattggcaactttttgcgacaatttcgtcgtgtaggtacaccatctacccacgtcagtcttgtcatgacatttgagtctgcaagaagtactggtaccgattgtcttgatgtactgctataaccttcttcattctagtaatatttaacactgctattataatgtatttcatgcaataagat

SEQ ID NO: 8454 - DNA, 213 bp, Diabrotica virgifera
  Clone ID: pGUT1851
aacaacttgaacaagttcaaccctggaaccgtgaacaagtactttcatggaaccaaggacaagtactcccatgggcctacagacaacttcttccattgaactatgaaaccgttttaccatggacccgccagtattccgcacaaaacaacatgaacctagagttccaatactactacaatctccaccaacaacatatgccattgttccaatact

SEQ ID NO: 8455 - DNA, 90 bp, Diabrotica virgifera
  Clone ID: pGUT1852
tgggatcgatccttgccagtagaccagatctttagacggaaataagggctcgtgcgacagtcgtagcgaactacgattgcctagtaaagt

SEQ ID NO: 8456 - DNA, 214 bp, Diabrotica virgifera
  unsure (1)..(214): unsure at all n locations
  Clone ID: pGUT1854
agtgcattgaagacagttcgtcgacaagggtactacgcttattcggttaacgataaattgaagattattggattaaacaataatgtctgctataattttaattggtggttgttattaaaaacggagtatctaaatgagcagctacnatttctgatccaagaactacaagaatcagagcagaaaggggcattcgtacacatccttggtcatgtat

SEQ ID NO: 8457 - DNA, 263 bp, Diabrotica virgifera
  Clone ID: pGUT1855
tcggcacgagatgctatacaattcaaccatccaagcaacgtttatacaagatctctgaatacgaaaagtgatgataagtgtgaataagtgatattaagtcatgatatgtgataatacgaaatgacaagtgacgatcaataataataagtgatgaacaattatccgctctacagagaacgatctcttctgcgttcttggtataaatctaacttttacttcgttagacggtctcatcactatatcaactttatggataatatctg

SEQ ID NO: 8458 - DNA, 295 bp, Diabrotica virgifera
  Clone ID: pGUT186
atcaatatgtacttataacatcattatcggcggtaatatatctctaattgtgcctcgacattttctaatctattcgccagtctttcctatccattggcaactttttgcgacaatttcgtcgtgtaggtacaccatcttcccacgtcagtcttgtcatgacatttgagtctgcaagaaaagctggttccgattagcttgattttcttcagtaaccttcttcattaaagtaataataaacactgctattataatgcatttcatgcaataagatcatagcatgctttgttttccatca

SEQ ID NO: 8459 - DNA, 164 bp, Diabrotica virgifera
  unsure (1)..(164): unsure at all n locations
  Clone ID: pGUT1865
gcagcccgaaataagttgtctacttcgtctgtccctagtaacccataatgtaacagccttctcctctcctacgggtaggcatgtgactgttagattancgtgtaatctgaacctagtcggttctctacgttcccaaattgaccttcctaaaagtccttacaacc

SEQ ID NO: 8460 - DNA, 134 bp, Diabrotica virgifera
  Clone ID: pGUT1866
gtggaaccaagaatggacccaaaacttggttggacaagagaatcattatcctctcttggggcaaaatatgcccttagtatattaaaaagtattctgttctaagcatatgatttaaaataaaaaaaggcatatat

SEQ ID NO: 8461 - DNA, 289 bp, Diabrotica virgifera
  Clone ID: pGUT1867
tgatggttgacccaatgtgtttggagcttcacgaagatatgaacaatgtcacgaccgcccaaaaacaaaaatatatgtatctaacaccgaaagagataaaggagagtggtaagaaatatcatggaatagtgcatatgtaacgataggaagaatcctcatacgtcgtggagagtgatcgttaccgacagcaataaatggagcgcacagatgagtgggacaatcgttgaattggaaaacattactgaatttatggcttatacatttttcggcatgtatgtgtggtccaaca

SEQ ID NO: 8462 - DNA, 189 bp, Diabrotica virgifera
  Clone ID: pGUT187
ggaactgggagaaaaagccacgctgtgcacaaatgtctatgtgataaatctaggtgaacatatcgctgcaggaacacttacaggtcatgtgtgaaaagtatggtacaattaccacctacaagataatgagtaacgaacatcgtacatctcaaggatttggtttcgtacccattgacagttcacaagcag

SEQ ID NO: 8463 - DNA, 209 bp, Diabrotica virgifera
  Clone ID: pGUT1870
ctagtctcgagtttttttttttttttttggtttaaaatttacgggaaatggatttaaacttttttatttaaatatcccatttttaattcaataagggattttatttatggaaaattttccttttccggcggttccttgggctataattaccacctatggctgggataacattatcccctacaattttgaccatactaccagggtaggat

SEQ ID NO: 8464 - DNA, 227 bp, Diabrotica virgifera
  Clone ID: pGUT1871
tcaagttttctctatttttttttaaccggtttaccactttaatttaaaaaattggcttaaaatacaattaatttaaacaacattccttttacccctaaaataaaaaaacaatttggttccccctactttccccaaacaacctatttatctttcttggctccacccaaacttgggtctgcatccccggaaataccctttgggttcccggtcggtcccgcctaaaaccc

SEQ ID NO: 8465 - DNA, 209 bp, Diabrotica virgifera
  Clone ID: pGUT1872
tcaaagtgggtattgttcttcacagccactgtgtgtgtgtcatccagcgtgcagggagctgatctgacgcttaccctgttttaagaaagagtatgccctggttgtcatcaatttattctaacacagctatatccttcatacgctaaattggcagatagcttgagattggactgtgtaccctatggatggagtgactcttcacgtagcgc

SEQ ID NO: 8466 - DNA, 324 bp, Diabrotica virgifera
  unsure (1)..(324): unsure at all n locations
  Clone ID: pGUT1874
gatatgatgatatattggtatgaaactaccacgttgccacgtcataaaaaaggcaaaaataaaagaataagacggcataaacacatagtcctgatggtaggtttgtaagctgaaagcgctcagctaggaatttcaaaataacttaaaaaatacgattatatcccattctttctctttttattattttaaagtaataatctacctaacaataaaacactgaaaacttttgttttctatacttccacaaaatttattataactatgtgactacagctgtttcggcagagtggcattctcaagtgatttagtntatctcgatggggg

SEQ ID NO: 8467 - DNA, 379 bp, Diabrotica virgifera
  Clone ID: pGUT1877
tctctctctctctctctctctctctctctctctctctctcgcgctgactcggtgagagaaaaattatgtgatatattgggtcttttcgtgttaaaatatatttataaataagagagagaaacagcactggcgcacacgggttgagactcagataatgtaaaattttaaaagtcgaagagacataaaaatataggtgcgagaccaattataaactttaaatccacatggatgtgtgtatctatataagtgatgagatatcgcaataaaaatttagtgtgttctcgagagtgggtgaggctgaaaatcaaaaaaaaaaaaaaaaattcaggggggggggcggggccccctttccaaaaaaaaaatttttttaaaaaccccg

SEQ ID NO: 8468 - DNA, 263 bp, Diabrotica virgifera
  Clone ID: pGUT1879
aaacgtatcatggactggatcaatcggtgttgcaagcactcatatcgaacttaataccaataaatggtatggccttgccgactgggatatctcagctaagcaaatcaatgatgactctgattacgatgctgtctttgactacaccacatactggcccagttttagaatcgtcggcaactacgatgcaaccgttaaagagcttttccttacacagcactacataggatcctacaacataaccatgattaaaccaaaatggactg

SEQ ID NO: 8469 - DNA, 262 bp, Diabrotica virgifera
  Clone ID: pGUT1883
tctagttcttctttccctagtaacccttagtgtcgctgcatactacccaagtactggtaggcaggtgacagtaggagtagctggaaatgtgaaactagtcggctctcaaggttcccaaattgacattcgtaaaagtccttacaacccaagaactgtcgacgtcaccctcagaagtccaaatgctccaaccagaactctgcaaattgatgaaaccaggagcgggccacaacttggttattccaacctccaaagtgtcaacaac

SEQ ID NO: 8470 - DNA, 263 bp, Diabrotica virgifera
  Clone ID: pGUT1885
gacaaaaaggctgttgcaggatctcaggaaattagaaacgttaatggtgacaaagggtcgcttagaaaaggttcctagtgatactttccaaaacaatcaagaaataacgatcttagaattggatgattcttccataacaacaattgaacctggaacttttgacaatctccaaaaattagatcggctcgacctcagatccacaggtctccaaagtcctttcgacgtaaacttaacaaaaaaaaaaaaaaaaaactcaagggggg

SEQ ID NO: 8471 - DNA, 206 bp, Diabrotica virgifera
  unsure (1)..(206): unsure at all n locations
  Clone ID: pGUT1887
gaagtatcaggctaaaattgcaatgactaataattccgaaaaaaatcaaaatcagacttccgagaataattctcaggaagaaaaaaaggttaatacatactccgaaaaagatcatggaccttttgtagtatatcttgaatctacaaatataccgaatataaaaattggcacattcaatacaattaaaatagctcgaggaaganncg

SEQ ID NO: 8472 - DNA, 167 bp, Diabrotica virgifera
  Clone ID: pGUT1889
tagactccttccttgatgtttacgttattatatttaccagacaaactgagtttacgaccgggagtgttcttgtttttcctatattctacactggcttgaccttgtccgttaagaatatcattcctagtgttgtaggctccattaacttttccttgcaagtattgatc

SEQ ID NO: 8473 - DNA, 230 bp, Diabrotica virgifera
  unsure (1)..(230): unsure at all n locations
  Clone ID: pGUT1893
cagatatcgaaaagaaaatgaatgataccatcgacgacctcgccaactgcattgaagatatcaccattggtgatagtaccgtctgcgctaccgcacaacgtgccattgaaaaatgcgccaagccagtcattgaattagttagcggatgtttgccagatgaatccaaagaacttcccgccttagctgaaggagttgtnctngctatatggaaacaagcttgcgcttctaca

SEQ ID NO: 8474 - DNA, 246 bp, Diabrotica virgifera
  unsure (1)..(246): unsure at all n locations
  Clone ID: pGUT1894
cagcgatatacgcacctataattatcgcttatcattgtttgaatacaattttccgttttcagatcaaataaaccagcatggttcaaatagaaggaatatacataaatgataggagcgagaatttggacgactactttctaaaagtatgcgtgccgtttattccaagaaaactgctgtgctcgtcaaagccgacattgganatcaagagagagattgatgattgggacattacggtgtctacacttt

SEQ ID NO: 8475 - DNA, 166 bp, Diabrotica virgifera
  Clone ID: pGUT1896
cacctgccgaatgcggcacgagctcgtgcccaatacggcactatcggcactaggaacctattattccggttcaagacctctatctctcacatctctcatataacctttatcccgcatttggtcgaaatctgaagtctcgttcataagtcatcgtgctattggtcac

SEQ ID NO: 8476 - DNA, 290 bp, Diabrotica virgifera
  unsure (1)..(290): unsure at all n locations
  Clone ID: pGUT1897
ctgttgctttgatgtatcgatataagctacatagtagatacatagaggaaatcttgtgctttattctattttagaatttcaatggttaatatattagatattaaaataatgacccaaaaaatctatatagtgctatctaaatattgctgctgcaagaatttttttattagttctttaacccagttttatgaccttcatgtacatatatccaaatctatattgccagggttatggannnatatacctggaattttagcctgaaattataataccatgatgtacacaaacta

SEQ ID NO: 8477 - DNA, 237 bp, Diabrotica virgifera
  Clone ID: pGUT190
aatgtaactttttaccttttttttcacatatcaataatgatataaatatgttacatattgatatggcaattataataaacgaacgaatgtttaattttgtgatcttccttttttaatacgtacatgcatttacaaattattttttcaagtaaaattgttcacagagaactactgttaattaatttatttaaaattgcacgacacgcataatatgttattaataaattatgattattg

SEQ ID NO: 8478 - DNA, 207 bp, Diabrotica virgifera
  Clone ID: pGUT1902
ctcaattaaaaatgaattcagtccattttccacgtattatcaagtcctgcaatttcatagcaaggaggtttataggagtaacacagtctaggctcaaatccttcgtggtacaagatgaccaagattttttataataggtagagaagagcatggatccattaattgtggatttcttcacaaactggtgtggtccatgcgaggcattgg

SEQ ID NO: 8479 - DNA, 287 bp, Diabrotica virgifera
  unsure (1)..(287): unsure at all n locations
  Clone ID: pGUT1903
caacaatgctagctgctaaagttgtcttgtttttgggccttgcccttttcgtctcagccggtgaagatcttgacaagggttatgaaattgtggaatgtgccaattatgtaatgagagcaggagtacccgaattgggagtaccacaacacgacccctacgtcaaactcagggacctacaatggagtggatacctcggtgttgccaagcccatatcgagctccatgatnatagatggtatggtcttgccgactgggaaatttcaactacaanatcagtgctgacactga

SEQ ID NO: 8480 - DNA, 275 bp, Diabrotica virgifera
  unsure (1)..(275): unsure at all n locations
  Clone ID: pGUT1904
agtttgtaaagggagtatcacactatctgcgggctttgtatacctatattggtaataaataggatcttataatttgattccagcaatggaattgctggtgaataacctttctttgtactttactaattagaccagtggttcncaaccttttatgtctggcgacccactttctgatgtcttttcatattcgcgaaccattgctcactcatgatgatacgctattctgtactctgtacgccactcaacttctgtaagatccacgccgcgaaccacct

SEQ ID NO: 8481 - DNA, 258 bp, Diabrotica virgifera
  unsure (1)..(258): unsure at all n locations
  Clone ID: pGUT1912
tgaccggagatgtgcaggacgaaaagctaaggtcagtagtaaacggccctgttcggactaatgcagttgttgatggagctgataagggaacatanctattattaggttttatatttgaatgtaaatttgtactcactatgccagtattatggttacagacactgtaaatagaagtatcgaatatattgtttgtganatttatttaataaaccatattttgttttataaaaaanaaaaaaaaaaaaaaccccagggggg

SEQ ID NO: 8482 - DNA, 227 bp, Diabrotica virgifera
  Clone ID: pGUT1916
ctcgtgtttttttttgtttttttgtttttgggggttttggttttattccccaaaaaatttaaaaccccccaaatttaaaaacccaaaacctttttttttgggtttccaaaaaaaatttttcccatttccccggaaaattaaggggttttccccaaaaaagggtgtcccccccccaaaatttctccccccatttcccgggccgggggttaaaaaccgccaaaattttt

SEQ ID NO: 8483 - DNA, 295 bp, Diabrotica virgifera
  unsure (1)..(295): unsure at all n locations
  Clone ID: pGUT1929
ttggttttggctgttttggcttgcgtcgctcttaccgcttacggtgaaaacgtccaagttaatgactttttgtgcgacacctgcgtaacttttgcatcaacagtcaagaaattcgtagacgatgaactcccaattgaagaagtagaaaaagccgcaaaagaactttgtgacctcctaccgggggatttganagatttctgcgagaaagatttgcttccagaagtcgagaatatctacaatgatgtatccaaaataacaccccaagaagcatgccaagatttgggattctgtgacg

SEQ ID NO: 8484 - DNA, 245 bp, Diabrotica virgifera
  unsure (1)..(245): unsure at all n locations
  Clone ID: pGUT1930
aaaacttcacaatgctgtgtacttgatagctaaataacacagataattatagaattttttttcaaactctgtatagcatttaaaaatattgttattaatcaacaaataaatattgataattannanagaaaaaaaaaaaaaaataaatatagaaaaataaaaaaaaaaaaaaaaaaaaataanttttttttggggggggggggggggggccccccccccccccataattttttttttttaccccc

SEQ ID NO: 8485 - DNA, 192 bp, Diabrotica virgifera
  Clone ID: pGUT1931
gacaagtctaatgttaagttagtatggaaagcacccagcaaagtaggaaaatatgttttatatgccaccgttgcagaaactggagaaagattctgggcacgaaaacctaccgaagtcattaatgttttctaaacaaaattgtgttaaaaatatttaatttttattaaaaactattcagatgtgatatacttt

SEQ ID NO: 8486 - DNA, 216 bp, Diabrotica virgifera
  unsure (1)..(216): unsure at all n locations
  Clone ID: pGUT1938
cagcaaccctcttattccgaggttgtacggtttacccaagatacataaagttggaattcctatacgtcctgtcgtcagtttcattaacactccagtttctattttatcaaaatacatactcaacaccttanaaaatttaatcaacttcacaccccgtnttactgtatcaaatncataccaattatttgataaacttcaactcatcaatctcaatcc

SEQ ID NO: 8487 - DNA, 233 bp, Diabrotica virgifera
  unsure (1)..(233): unsure at all n locations
  Clone ID: pGUT1944
gagaaacgaaagagaacaacttagagggtggaatgtggaatacgaaagtcgacaaataaaaccttggaatcaacccgagaacgataatatgtgaaccactaagatccagcgtgacctangatttcttggtctattagctatgaacggaatccaaactctcttatattttttagtggtagaattccgtgtgtttgtttactactgtgtcgcaaaaacgcaacatactcatacca

SEQ ID NO: 8488 - DNA, 166 bp, Diabrotica virgifera
  unsure (1)..(166): unsure at all n locations
  Clone ID: pGUT1946
tggatgatgatggtgatgacgacgatgatgatatctcttttgattactgaactttcatttgttaatatttttctattgtcgtttttctctattactttactaattattttgggaatattgtctgtattttanagaatanagaaatanatgtagttagaattgtaaa

SEQ ID NO: 8489 - DNA, 330 bp, Diabrotica virgifera
  unsure (1)..(330): unsure at all n locations
  Clone ID: pGUT1950
tgagatactgactgtggtcaatggaacaaaaatcgaatggattaaatcttaccagcacacattcatggacctcttcaactcagacgactatcgtcctgtaaggatcggctggctancaaacggggagatatggaactccactctttatttgggcagctctttaggcgccggtgtcnanaccattggacacataatgacatcggcaattccaacatacaataatcaacagaattggtatccattttacggaagttcattcggggaacttatgtatanagtattagtttattatatntanatacttaanaagtactctnntttataaacaat

SEQ ID NO: 8490 - DNA, 109 bp, Diabrotica virgifera
  Clone ID: pGUT1951
aatacatctgattaaaatgacttgttaaagaatgttgtgttaatttgtttctcttattgtttatacgtgttatttgtataaaaaagtgcaagtgttcgatgactcatct

SEQ ID NO: 8491 - DNA, 264 bp, Diabrotica virgifera
  unsure (1)..(264): unsure at all n locations
  Clone ID: pGUT1954
ctttatgtttatttccatcccattctttgtatattcctgttccagtttcctcatcatagaactgaggtcatcttcgtcttgtgcgatcacttccttcgcactttcttttccatggtttcagggttttnttacaggaatatnttgaacagggtatgggatgtggatcanccctgtattantcactttgtggtcttaaatggactgcatattatatttcccattttaatagctactgtgttattcttgtagattggtnttactgct

SEQ ID NO: 8492 - DNA, 304 bp, Diabrotica virgifera
  unsure (1)..(304): unsure at all n locations
  Clone ID: pGUT1959
attttatttaaaatatttacaagatgaaacctattgttttgtgtttgatgataatagcagcatctaaagctattccaacaaacagattaaccaatgatgatgccaacttgggatattttccatggatcgtcgcgttgaatatntacgcccgtatgccatggtacgagataacttatcacgaatgtggatgcgtacttgtaagcaaatcttgggtttttacttcagctagttgcgtcaaatctaatgcccaatggaatacagtgacagagatctacgctggtttcgtacaacaaaacgacccgtc

SEQ ID NO: 8493 - DNA, 248 bp, Diabrotica virgifera
  unsure (1)..(248): unsure at all n locations
  Clone ID: pGUT196
gtggaactccactctttatttgggcagctctttaggcgccggtgtcgaaaccattggacacataatgacatcggcaattccaacatacaataatcaacagaattggtatccattttacggaagtcaattcggggaccttatgtataaagtattagtttattatatttaaatacttaaaaagtactctttttaataaacaatatgaaattaanaaaaaaaaaaaaaaaaaaaaccccaagggggggccc

SEQ ID NO: 8494 - DNA, 200 bp, Diabrotica virgifera
  Clone ID: pGUT1962
cgggaaatgagcttcttttatatgtaaaagaaagaacaaattaattatattatatgtttaagcaacataataaacattttaaattttaaaaaaaaaaaaaaaaaaaaaaaaaaaaaaaaattttaaaaattcccgggggggggggggggggacccaccccccccaaaaataattttttttaaaacccccgggcccccttt

SEQ ID NO: 8495 - DNA, 331 bp, Diabrotica virgifera
  unsure (1)..(331): unsure at all n locations
  Clone ID: pGUT1966
gtcgtacccaatatatcaattcagagacaaatgagagacacgtcctagaaggagaaacacaaggttcaacaactggggaaggcaaatttatagtacatttcttaaatccagacgtaactgtacctttctgggttcttggtacagactatgaaagttattctgtaggtttgtcctgttttgaacgagatggtgctcctctagcgagccttttcatttcaacaagaactccatttccaccaaaagatctggtggattcgattctccaagttcttgacgacaacnattttgctataaagccactaatcttcacagaccaaaatgaatgtactta

SEQ ID NO: 8496 - DNA, 314 bp, Diabrotica virgifera
  unsure (1)..(314): unsure at all n locations
  Clone ID: pGUT1967
gtcacgtcaaggcaaaatcaggtgcctacatagaccttaaatctgtcaaacctaacgaatccacaacagcaactttaaaatcactcagtatgtccaacttaaaaagcgacgctatcttcgaatttatcattgaccaagtcaaggctgatcgcagcaaagccaaatctgttggtggagtcttcttgtacaatattacaaaggatggcaaacaagttaaacaatggaccatggatttgataaatgctaaggtctttgatggannnaactgaagggcaacgaacacaaccttgaacatctcagatgatgatttcatg

SEQ ID NO: 8497 - DNA, 296 bp, Diabrotica virgifera
  unsure (1)..(296): unsure at all n locations
  Clone ID: pGUT1971
ccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggataaggtttttactgaaggtcccaatttcatcgacactttccctgacaagtatgacgaccaccttgctanagtgctagatgttacaaggaccgtgcttactanaatcgctcaagcacttanagttgttatagataaagttgctgaacaaagtgatgatgct

SEQ ID NO: 8498 - DNA, 318 bp, Diabrotica virgifera
  unsure (1)..(318): unsure at all n locations
  Clone ID: pGUT1973
gttgattaattcatttggctgttatacttggaagtttctggagtttttattttatagttttttaatgtactaaaagccaaatatcagttgctaagattttatagtatatttttttttattaatacaatttctgctacgcacttgaaacgtgatgtatatggttagttatatgaaaaatccgatatagtcagatcaatgaagagtctatttgtatattgcttatgattcggtgtgattttgacgatttttttatataaatttttaaatattgaatataatgtgagcgtgtagaanaaaaaaaaaaaaactcaagggggg

SEQ ID NO: 8499 - DNA, 128 bp, Diabrotica virgifera
  Clone ID: pGUT1975
acacaagaacgtttgtggcaaactcaataccaaactctaccacgcgtgtattaaaaactgctttatttgtaatttgttgttaaaatgtttgttataattgttgaaaatatataaacatttgttttttc

SEQ ID NO: 8500 - DNA, 427 bp, Diabrotica virgifera
  unsure (1)..(427): unsure at all n locations
  Clone ID: pGUT1976
aacatggtgaaatatttagtgataggtatttttatatcgtttagttttatactcaataaatatgtatattgtgcaaatataccaatatgtctgaatcccaaggaacagggaactctagttgcagatctgcagattgaaaaaaatatgtttgactcaatttatgttcgaataccagaaagcggttttcttgatgctgccatatcatgcataaagatatacgatatcggaaatagtttcgctgtacctgttataaatgatggcggtcttggattcgcatatgtagaaatctctatagaacaccgaattctanaggaactaanatataggatacaagtgtttaaagaatatcattgacagttctgataatatanttaatatttgctttgtgattttcatttctaaaataaaaaaataaacttttttggtt

SEQ ID NO: 8501 - DNA, 304 bp, Diabrotica virgifera
  unsure (1)..(304): unsure at all n locations
  Clone ID: pGUT1977
gtcaaatcataaaaatcatccttatcatttagtagatattagaccatgacctttattaggagcttttagagcaatattaacaatattaggaataattaatagacctaatactgttcttaatcagtttattggtaaattaaaattagatgtagggtcgaaagaagaaaataaatttattatcattttcaattgaattttaaattagtttttttagttttaaaatattttggtttataattaaagttaaaatagtttanattattanataaaaaaaaaaaaaaaaaaaaaaaatccccgggggggg

SEQ ID NO: 8502 - DNA, 160 bp, Diabrotica virgifera
  Clone ID: pGUT1978
atcatgtctatttctgctctcgcgtgtcgtctacagcgatacataacctctatgcagatctttgtaggccctgtctaccgattacgaattatttagtatatgtaataacttgtctgtccatattcatcgactaatgatttgtagatgtgaggtcagcccc

SEQ ID NO: 8503 - DNA, 215 bp, Diabrotica virgifera
  Clone ID: pGUT1986
cccctatctaattcccgccttctatgctaactctggacaactttcgggtgaattcgctccttctgctgctgcctaggttattataagattttatgaccttcttgtgctgcggcctaaatgattaacatatgttatgaccttttgcacccccgggggggggcagggtccccattcccccctaaatgtattcttttggggggccccgggcccccttt

SEQ ID NO: 8504 - DNA, 195 bp, Diabrotica virgifera
  unsure (1)..(195): unsure at all n locations
  Clone ID: pGUT1993
gagagagagagaagagagaactagtctcaagttgttnttttttttttttttttgggttnnnnnnntttttaaaactttttaaaaccctttttttaaaaaaaatttggggcctttttttttttacccccccttttttttttnnaaaaaaaaaaaaaaaaaaaaaaaaaattttggggggggggggggggggccccc

SEQ ID NO: 8505 - DNA, 251 bp, Diabrotica virgifera
  unsure (1)..(251): unsure at all n locations
  Clone ID: pGUT1996
aggaaattcgtatctacatttgaagggaatccagaaaaaaaaaacccaatggagctaggtgtatatgtaggaatccacccttcanaagttgttattgttaaacttaaaatggacaaggacaggaagaagatcattgacagaagagccaaaggacgtttggctgctttgggcaaagacaaaggaaaatacactgaagaatccgctgcctcagctgtagaaacatcttaggtgtataagtaatttttaataat

SEQ ID NO: 8506 - DNA, 320 bp, Diabrotica virgifera
  Clone ID: pGUT2001
caacaacttgtagaacagaaccaaccaattggtcaagaaatatatgtccaacagtatggtttgaacaaacaagtagatcagcttatccaatcattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctggtcaaagaaattt

SEQ ID NO: 8507 - DNA, 66 bp, Diabrotica virgifera
  Clone ID: pGUT2007
ctcgttcctaaatcagcacgacccgcacgggctctctctctctgtctctgggtctttttatctctc

SEQ ID NO: 8508 - DNA, 179 bp, Diabrotica virgifera
  Clone ID: pGUT2010
gtctcgaggtcttttttttttttttttcccccaaggggtttattttattttttaccgggggccctcaaaacctttaagggggccacacttgggggggctttgggtcttttaactttgtaagggggggtttcttttttttgggaatattttttggggccatgttgaaagaattctcctta

SEQ ID NO: 8509 - DNA, 255 bp, Diabrotica virgifera
  Clone ID: pGUT2017
cggcacgagctttttctgtctttacacggcaaattatgtgtagtaaaattctcactggtatggatatgtaaacattactacttgacaatgtcatcattaactttgaagagatggcttttaaatatttttgaataggtaattgtataactacctaaattattaattcagttaactaataggtatgataattttttcactaactatgtatataatgattgtaataatttatatactgtacaacaaaaactaatactc

SEQ ID NO: 8510 - DNA, 325 bp, Diabrotica virgifera
  unsure (1)..(325): unsure at all n locations
  Clone ID: pGUT2020
caagccgcttcttcaagaaccaagccctcctttggacccggaatcttaaactaccaccctctcaaaccccatggggaatccccgacacattttgatctattggaaaggtcgaaagaaagggggagggaagctggagattcaagtgaagttaaaaacaccaattcagactcaacaggtcgagcaaattcaagagaggtggttagtggtcgaccagtaatcgcttattgttgatatttagagttngctatgaaattattatcatattataatgtatagctntaacttttatacagtgagcgcgtaaaggttggaatgagttcatttt

SEQ ID NO: 8511 - DNA, 125 bp, Diabrotica virgifera
  Clone ID: pGUT2021
caaaaggggccctttttgctttgggaaaatttagggcccaccctaaaagaatttgccccccagggttttaaaacaaaaaaatttttttggttttaaaaaacggccctttttcaaaaaaaggggaa

SEQ ID NO: 8512 - DNA, 414 bp, Diabrotica virgifera
  Clone ID: pGUT2022
cctaatttgatctggctctccgtccaattttcagcactattcttcacttataaacaacccctgggacctgctaacctatctaatccacgaaacgtcgaactgctcctcagcgatgcccataacataatgacttctttttcaaactccctcaatcattcaaaccacttttccccttccaaattgccaagactcagaaacatttctcttttccattcgacaaaacaaacagtcattttcaaaattattccgaccatccaattactttcggggaaccctataacatttactctgggggaaacaaagatattaaaattccaaactttcttttaaaccatttttctagaaaatgataattacctctacctgtggaatctataggtccccgaataaacaaactttccattttaaacctaa

SEQ ID NO: 8513 - DNA, 299 bp, Diabrotica virgifera
  unsure (1)..(299): unsure at all n locations
  Clone ID: pGUT2030
cacagttttatgaaagtaccctgaaaacccactctatcctgaagatcctgcagccaagcagcaggttaaggatattattaacaaggcaggtggtccacaaggggtttttataaaaatcgtattaggaaaagaagaacattcagcagaagaatgggctaaattgttgcttgaagctcttcagcctttggaagaagaactttcgcagaggggaacacctttctttggtggagataaacctggaatggctgattacatgatttggccatgggcagagagagcangatgtataggaattaaat

SEQ ID NO: 8514 - DNA, 122 bp, Diabrotica virgifera
  Clone ID: pGUT2031
agatctagtattttttattttatttttttctcaaaagtggggcctttgttcgggggggggggagtttctcacttctctcttataaaatttcccccccccagtatttttaagtcaaaaatttt

SEQ ID NO: 8515 - DNA, 344 bp, Diabrotica virgifera
  Clone ID: pGUT2038
gtcgtgtacgtcgtctcaatccattgaccaacgctaaggccatgcttaagttgaatccatatgctgctgtactcaaacgtgaagccattttgaagaatcaaaagagacagttaaacagggaagaacttttggccaagaaacgtggtattaccgtgagtgccgacaacgtcgtgattagatccagaaaattgcaagaaaggagaagggcacaaatcttgaaagataagaaatcaaagcctaagaaggccaagaaggctccagccaaggccgcaggatagaaataacggactgctacggtttttgcgtattggtaagtttatgcactttgactgtggtaatccgag

SEQ ID NO: 8516 - DNA, 288 bp, Diabrotica virgifera
  Clone ID: pGUT2047
cgtgttcaattaggcaggcttgactgcggagaaaatgctgtacaaggttgtgctccctgttgtccagaagcagaagcaacttgttccaacaaagttcctcaaccatgtcctggtatttgcactagagaatgtaggatccaatgtcgttgtgctcaaggatacttgaaagacacggccactggaaagtgtgtcaaagaatgttaatttcttatttctaaatatctcaattatatttacttaataattatgcaatgtaaaacaaaaatataacaaataaatctttatatt

SEQ ID NO: 8517 - DNA, 370 bp, Diabrotica virgifera
  unsure (1)..(370): unsure at all n locations
  Clone ID: pGUT2048
ggcaccagctcgctttttatataatcaaatattcaaaaaattcgatatcctggggtccagcttttttaacactttctcatttttgactctgtccctccatgatgttctacgcattcggcacaggcacaacatttcaaaagctttaagtttggtaatggatctgatatttaacgttcacacttccattccgtacaaaagaacggaccaaacgtaacactttagcatcttgtatctcaggttgaaatccaacttgcgagcagaagaaatttacgaagtttaaaaaagcttccagacttggtctactctgctctntatttttagtttcaggggccccaccatcgttgcatttgggtaactatttctgcctatg

SEQ ID NO: 8518 - DNA, 126 bp, Diabrotica virgifera
  Clone ID: pGUT2051
ctctctctgtctctctctctgtctctcggtgtctctctctctctctctctctctctctctctcaccgacagagagagactgaaagagagagagaaatagagagagtgagaataaaaaaataagtgg

SEQ ID NO: 8519 - DNA, 281 bp, Diabrotica virgifera
  Clone ID: pGUT2054
tcgcaccaagcacaatttgatatttgcattttgaactaataaaaaagggatttcttaaaacagggaccccctaattgcaaaagctttctaacctacttaaaggctcctccgggcttaataaatgaactctaggttaggatgggctaaaatttcttttttgggcaccccaccttcttatgaaaacaatttttggaaagggtatccagatctttgtcaaatttccatataactgtttgtttcagttgacccaatgcattaataatactgttctttttatcatc

SEQ ID NO: 8520 - DNA, 233 bp, Diabrotica virgifera
  Clone ID: pGUT2058
tggccctgggacaaaaatatttacacctacctacagagacctttttatgaccacaacgataagatcagtgatgttcgagggatttgagtttgccagatcatcatcagatgttggatatgcttgtgaagtaatcagacagcagatcatcgaaaaaacttaaaaaatgaaaaacatacgaaagatatacagtaaagaatatccaggaatggtggaaagctttaagatctcatttt

SEQ ID NO: 8521 - DNA, 364 bp, Diabrotica virgifera
  Clone ID: pGUT2059
agtaccattcagtgttaacctcgagatatcagatatttaccagcaacttcatcatggctgatagagattcaaaggcaaatactgacaatcgggccacacagctaaatgccaacaatgacagattctatcaaagtagagggcttgattctaggccagataattggaaggatactgcttcagccggtggccaaggatatacccaacaggatagagacaacagatccaatcagctgaatcccaacaatgacgcttatggaaaatccaggcaaaattagcaaatatttactaacgccaatgcatattaatactgtgtattttaattcatttttgacatagtggtactttaaatatttcataataaaat

SEQ ID NO: 8522 - DNA, 237 bp, Diabrotica virgifera
  Clone ID: pGUT2061
caaaaaacccgttcccacaactgaaaatatttgcacagttttgcccaaactcaagaaatgttcctctgacttccacggacagtactgcaagagcccagtcacccttagctctttcgccaaattccacaaagccgttgaaaccgaaactgaaaaaatttgccacaatcctgtcaaaaacgaagtcgcttaatttatgaatgttactttttgttaaataaattttatactcatcttttt

SEQ ID NO: 8523 - DNA, 394 bp, Diabrotica virgifera
  unsure (1)..(394): unsure at all n locations
  Clone ID: pGUT2063
gttacttgtatgcccacctccaattacccaccttcacaaataaatttaggtattaatatccttgtctccagatttacacatacgcctttgcgatgtttgaaataggtccattaaactttttctgtcttctaagtttttatccaaaatggttacctcgttagcaatgttgtaaacttttgaatattatgttcaaatttagttacacatagtttcaataaaaaattcatgatcggtcgggccttctcgaacctgcacatacacctcttatatattntttatttacataatacctaccggaagtgcaaaacctagccgttagttaatttaagtcgaactcgataaaaacaataaatcggccctttatgtaacacctatattnttatttcactaaaat

SEQ ID NO: 8524 - DNA, 339 bp, Diabrotica virgifera
  unsure (1)..(339): unsure at all n locations
  Clone ID: pGUT2066
aaaaaatctgatatacagctctttactgccaccaggatatagcgtgaaaactcgtatcccagcaactggatattaccaaagacctatcacctgcttactgctaatcgatcaaaaaggaagcgccagctcaccaaaaattatagaaggtggatatctcgacacttttgctgtagtaaatatcacttccacaactgcgcaaccagttagttactatgcaatagtatttattgattagcctatngattagcctttagtagtatttagatatatttatgcactactattnattatttaaatgatatattttcgttggataaataaaaaaaatataatattaaa

SEQ ID NO: 8525 - DNA, 336 bp, Diabrotica virgifera
  unsure (1)..(336): unsure at all n locations
  Clone ID: pGUT2067
cattggtatatcaccaaaatgtgatctctcaacaagttgagcaattcattcaacaaggacaacgtcttccccaagacttgctttcccaacaagtattagtctaccaacaagttcgccaattgattaaagttttgagcacccaacaacttaacatgatcaacttcatccaatacctcgttgaacaaggtaatcaagttgatcaacaattgtacgctgttcaaagaaatttttaccaacaagtccaaagacttgttaacaggtagttcttcacaatctcaaatcaaagaacanatccaggtacttatccaacaagaacaaactggtccacaagaacta

SEQ ID NO: 8526 - DNA, 368 bp, Diabrotica virgifera
  unsure (1)..(368): unsure at all n locations
  Clone ID: pGUT2070
tccaggctggatggagcaaagttgttcatggacccaatagagccaaaccaacatggcatgtaggtggtagcttcagattctcacgatccccaaagccagaatgggaagtaaatcctggagctaacgatgatggaaatggtaacactaatgctggtggagaagtcccaaggccagaatgggaagtaaatcctggagctaacggtgatggaaatggtaacactgatgctggtatagaagtaagaaataagggcaaagatcatggtttccaggctggatgggacatgcacatgccatggctatatggtatgtnaggtgcacatggaagttttaaatttgaataattggtatggataaaatgtataataatt

SEQ ID NO: 8527 - DNA, 292 bp, Diabrotica virgifera
  Clone ID: pGUT2071
gagaaatcaaaaccgttatcgacgaacacagaaacaaacttccatcgaaatcactcatctgctcaactctccccaagatcaggaactgcgccaaagctcacattgaagcttcctgccaaaacacagtcaccagacaagctgccttgaaattccacgatgctatcgatgctgcccttaaagacgactgtgatgcccttaacaaagcctaaatcatttatgacaaaatgctccaaaaaattaataaaatatttttatagttaaaaaaaaaaaaaaaaaaaactcgggggggggc

SEQ ID NO: 8528 - DNA, 268 bp, Diabrotica virgifera
  Clone ID: pGUT2073
aagctgattcaccgggggcggcgtctaaactagggatccccggctggagaattctgctcgaagaaacttccggtggaatcctggaaaccctaaatggctgttttcattatccccggagggggttttcccccaaaatgctcaaaatttattaaaaggattcccaaaaaaaaaaattggaaaaactgtaccccacatttgcaagatatccctctataaatataattataataataatgcaactttaccacataggaaatcctacagccaa

SEQ ID NO: 8529 - DNA, 329 bp, Diabrotica virgifera
  Clone ID: pGUT2076
agtaaggcatcccattcgccgaagatactgggtaaattcaaaaggcttcatacattttcttaaacgacgatgttccactttatgttgatcaaaataaattgagaaataatagcgtttgcttcaaatcatatatccgtgatccattccatgcgtactttaatagaacaaggaatgtacttcagtattaccttatttttaaagatgatataaaacaggctcatctccatgccgtaaacaaatttctaggaaaacctaaagaccatcccaatgaagctatggtagctgaacccatatggacaacttgtgcaaaatataaaacgaagataaat

SEQ ID NO: 8530 - DNA, 193 bp, Diabrotica virgifera
  Clone ID: pGUT2082
actcttgcccatttccgccccaagccttgcggtgtttttttggaaaaatgcccggggtcttaagttaaaaaaatggtggtcaacggttttatttttgtcgcttgcctaactggtatatttccccaatgagcttggaaacatcgcccatggtcctccgctcatgggtctaagcctaaacccggaacatttaaac

SEQ ID NO: 8531 - DNA, 258 bp, Diabrotica virgifera
  Clone ID: pGUT2104
ctcgagttttttttttttttttggattataggttaaaaggggtccttttcggaaaaaagttgcaatgccataaaagtggcccaataaaattccctataataagggttgggttaaatttttaaaaaattttcccccttgtggcaaaaaaccattagttgcaaaaaaccttaaaaaaccaggttttcgcatttccgtttttaacccttttttgctcccttaaaacctcttttttttcacccaaaaaaactttttgattta

SEQ ID NO: 8532 - DNA, 170 bp, Diabrotica virgifera
  Clone ID: pGUT2106
caggttttgagtaaacagggttgccgcaatcccttgattccttaaactaacatgctctttaaacaattgtagcaataagttgacgcacagagcgagataacatacctacagcattattcaatgaaattcggaactgctttcctgaatatttttgatctgacaatctgatg

SEQ ID NO: 8533 - DNA, 295 bp, Diabrotica virgifera
  Clone ID: pGUT2111
cggcacgagcgagtttttttttttttttttttttttttgggacttgggggggggctactgttataaactcccccaaacccaaaaggtttaaaaaaaccaaattttttcctataagggacccttgggatgggggaacccaaatcctttttgacaaatgtccaaaaggccccttttttgggggtgccccaaacgggaaggcttaaaaaaataattgggaattgggcaccgttccaaaaacaaaagtgggaaaggagcccgccgccttttttttcccaggggggggatccaacaccaa

SEQ ID NO: 8534 - DNA, 312 bp, Diabrotica virgifera
  unsure (1)..(312): unsure at all n locations
  Clone ID: pGUT2114
ttgagtttgccccaaacgttctttggggggaaggacccattggggcaataactggtgggggaacacttttaaatggttgaagcataagtacaatctgttgggggattagtctttggtggtagatcaattcttggggtcaacatcttcgggttggatcaattgaactaattgggtgtaaatagtgaagtattgggaaaccaattcttggggaacggcgtatctttgttgtcccaaaagttgaatcaactgtttgaagtanngttgttgatatacgaattgtttaatcaaaacttgaagaactctttcaacatc

SEQ ID NO: 8535 - DNA, 347 bp, Diabrotica virgifera
  Clone ID: pGUT2117
cataaggttaatataaaccaacgtaagtttttggcggctaatcctttttggaaatgaagtttggctgacctttaaggggatttatgggcaatttccaaaccagtgctagtgaagttgaaggtcctagaatggtctccgttagtgattacaaggatatcaccctcaagttttgcgttgctcttaattttgtgaccaaaacgttcttcttcaaattcctctccaagagtaaaagaggtaactttagatttgccggcagcagattcagtaactataactttgttaccgtcttgtttgaattcgatagaaaattgaccgctatttttaatttggtctttctggataccata

SEQ ID NO: 8536 - DNA, 297 bp, Diabrotica virgifera
  unsure (1)..(297): unsure at all n locations
  Clone ID: pGUT2127
ggaggtttttcttccggactttggtgaattaaacattttacatttaaatgtgttatgactgcatgttacctctttacatctaatttttgacttgattattataaaactaatcgatgttttaacgcgtactggtaatttatactgtagcatttttttaaaatttataaataaagcattttttctgtgtgtnnnaaaaaaaaaaaaaaaaaaaaaaaaataagaganaaaaaaaaaaaaaaaaaaaaaaaaaaaaggggggggggggcccccccccccccccccccttggggggggggt

SEQ ID NO: 8537 - DNA, 183 bp, Diabrotica virgifera
  unsure (1)..(183): unsure at all n locations
  Clone ID: pGUT2128
gtctcgagttntttttttttttttttttttgggggggnaaaaaccaaatttttggcctttaaaccaaaaaatttttttttttggggggcgggtttttttttttcccccttttccctgggtaaagggggggggggccccgccccccattcccccttatgggggggggtttaccaatccccggcc

SEQ ID NO: 8538 - DNA, 364 bp, Diabrotica virgifera
  unsure (1)..(364): unsure at all n locations
  Clone ID: pGUT2130
caagcctttctaacttattgggaattagggtcccatttccaaatcagcggtattccatgaaaatgtgtactgctgagcacaggggctgccgctggaagtttcctcatgtcagttatggtcatagtaatgttcttattgacctctagttttccaattattgctgccactattggaacccactggctgtctggttgttcagtttcagttgttttttaggatcanttttcatttatagatatttaccagagacaagtggtaaaaagtttgtacaaattcaagacatgttaaaaactattangtttatatatcgttataaataaaacgttacggaataaaaaaaaaaaaaaaaacttgggggggggcc

SEQ ID NO: 8539 - DNA, 317 bp, Diabrotica virgifera
  Clone ID: pGUT2131
aattcccaaaaccaagaatgttttccgccttcttcaccaaggcctctttgcagggctttacctgaaaaccaaactttaccacaaccagttgacgactcaccaagggcattagtaaaatcattggtagctggaagacagattgcagcagctgctgctgctgaaggtgacagttgtgaatttggatcagccactactttgctctttgtggtctaggaggtatcctctcatgtggtatcactcacacagctgtagtaccacttgatttagtaaaatgccgtatccaagtagatcctgctaaatacaagagtgtatttaat

SEQ ID NO: 8540 - DNA, 317 bp, Diabrotica virgifera
  Clone ID: pGUT2132
agggaaacataacttcccgttcaaggggttaaggtgcttataaactgcgcaaaggttaatcaacaatggaaccattggactcatgatgtaactggcgatgaacgttttcacaatatgttgtatcaacaccttcctgaacacttatggagctccaacgagctaattgtaccatacatgatgaactacttcaaccaatacccaatgatatacacgacttatgcatgaagttatgcaaaccgcatgggctcaccaacaacttatgttccacgctatgtctgatttataccagcacttctgacaagccccatggttccacg

SEQ ID NO: 8541 - DNA, 309 bp, Diabrotica virgifera
  unsure (1)..(309): unsure at all n locations
  Clone ID: pGUT2133
ctacacttttttcatgctgattttggggtctctggtagggacattatttatgtttaatttgacctaacaatatcattntcttctctaggtttataattccgttgtctgggtattattgcaaagtcttctgtgtttcttacatcgttgctgataccaaatccaagatcgttccaggcatgggaatttcgaccaattcgtagtattacatgttttacatcttgatgccttataccttgtgggtttagaatatcgtcaaagcttcttggctccttgtctaactggaccatgaagagatccttgtattgatca

SEQ ID NO: 8542 - DNA, 217 bp, Diabrotica virgifera
  Clone ID: pGUT2135
aggaaaactagtctcgagtttttttttttttttttggaaatttgggccaaaaattttgcatttaaatttatttcaattggaccccaatggggaactattggattttcctttattaaaaatttttgcattttgaaccccaaggtttttctaaatatagggttattactcgggccaaattcggcacgaccttgtgccaaatttggcacggggggggggc

SEQ ID NO: 8543 - DNA, 211 bp, Diabrotica virgifera
  Clone ID: pGUT2143
ccaagaaggaagaaaagaaggttgaatctgaatcagaagacgacgacatgggctttgctctattcgactagactcattagttgtaagatcaaccttgttttgtaccttaatatatattttttaagttaaaaaaaaaaaaaaaaaaaaaaaaaaatctctggggggggggccggcccccattcccccttaagggggggggtttaaaattccc

SEQ ID NO: 8544 - DNA, 165 bp, Diabrotica virgifera
  unsure (1)..(165): unsure at all n locations
  Clone ID: pGUT2144
gaaaggctcatcaaacaattattaactttaaaaaataaaaatttgtcaagggtatatagtggtattgttaagtatattacaatataacttattccatcgaaatcttccgaaatccataatcttcttccatcgaaaaanaaaaaaaaaaaaaaaaaaaacccctgg

SEQ ID NO: 8545 - DNA, 274 bp, Diabrotica virgifera
  Clone ID: pGUT2154
aaaagtagtagttagtagctatagatatttataggtattttatttgaaatgctttggttgtcttttttagattttcggtttggtttcgaaatcctaaaatagatggcttaagcatttcaccagcatgttgcaaacaatttactgttgcatttatttaaagattgtattcgatacactactttgaacttttttacatttttatttactaaatttttgtagaataaagactgaatttctacagtggaaaaaaaaaaaaaaaaaaaacctggggggg

SEQ ID NO: 8546 - DNA, 250 bp, Diabrotica virgifera
  Clone ID: pGUT2159
aatgcaagctgggtttgctctgcgtttttcaaggcgccatggattattctcaaagttgaccttcagattcccgatgctgtgaaaggtgatatccaacccgtcattgatgccggtaaagcccttcatacagcaggcaaaaagtgcatccacgatcaagtacccgccttctatgctaacactggaaaacttttgggtgaaattgctacatgtgctgctgcctaaattattagaagatgttatgaccttttgc

SEQ ID NO: 8547 - DNA, 454 bp, Diabrotica virgifera
  Clone ID: pGUT2160
ctggagtccaccgggggggcgtctaaactagggatcccggctgcagaattcggacaacttagcaggcttttgctagtaaaaatggaatggataacatgaagggggattggtcgctctagttttggccgtagtggtgtgccaagtgatatgtgatggtgatgatactggttcctccagcaccaccatcgcggtcaccaccagcgaagctccacctaccaccaccagttcgaatgcggaacaatcatcaacaacctcagcacctgagagcagcaccaagggtggtgcatctacggccattcccgcaataggacttgtattgggaaccgctttacttgtgctccactaaaagcagaaaggacgcttttgatagtcactgttcacttaatacactcacttaaagtattattttcgaaaaaatatcaatttgctcaaaaataaacatcagacatacaac

SEQ ID NO: 8548 - DNA, 293 bp, Diabrotica virgifera
  Clone ID: pGUT2163
ggcggtcttacccgcaggggccaaaaaaaatgggcttttttgtgcgaataccctgcggtaggaatagtaaaagtagtccaggactacgtacgaaaagaaattccattggaagaagttgaaaaagaagtgaaagaattgtgcaaagttttaccaggagatttggaaaaattgtgcgaggacaagttaattccagcaatcgaccaaatgtacaaccagatggaagacactcctcctagagatttatgcgtagagttggaattctgtaattaatttggttgttagaatattataat

SEQ ID NO: 8549 - DNA, 390 bp, Diabrotica virgifera
  Clone ID: pGUT2165
attccgcacgggggaatctcgagtttttttttgggcctttttatttggggcgggcttacccgtcagcgcccaaaagaatgacttttttggcgaaacctgcgtaggaatagtaaaagtagtccaggactacgtacgaaaagaaattccattggaagaagttgaaaaagaagtgaaagaattgtgcaaagttttaccaggagatttggaaaaattgtgcgaggacaagttaattccaacaatcgaccaaatgtacaaccagatggaagacactcctcctagagatttatgcgtagagttggaattctgtaattaatttggttggtagaatattataataaaaactcacaaattaatttggaaaaaaaaaaaaaaaaaaaaacccgggggggg

SEQ ID NO: 8550 - DNA, 206 bp, Diabrotica virgifera
  Clone ID: pGUT2167
atttggacttggtccaagcggtagcatggatggcgaaatcaaggaatttaagttttaccttcaattttctttagacctcgagttttttttttttttttttatagggacactatctaataaaaagatttgggagcacatcaataataaaatgggttttgggtttaagagaggaccaaaaaatttcttttccaaataagagaattttt

SEQ ID NO: 8551 - DNA, 111 bp, Diabrotica virgifera
  Clone ID: pGUT2177
tctctctctctctctctctctctctctctcggtctatctctctctctgtggggctctatctcaatcaccccacacccacaaacggtaaaaaagacagacccaccaaccaaa

SEQ ID NO: 8552 - DNA, 163 bp, Diabrotica virgifera
  Clone ID: pGUT2179
gttggccccattgggcatataactacattaaagatcatggcctctgtctagagtctgactacaagtatcaaggattagacggtgactgcaaacagtgtaatccggttatcaaaaccatcaatggctatgcatctgtagatcaaaccgaagaagcacttaagga

SEQ ID NO: 8553 - DNA, 238 bp, Diabrotica virgifera
  Clone ID: pGUT2216
gtaatgcctatacataaattacacagaatatgtatattaccatggaactcatcaaaaaacatgcgtgagtagaagaggctgtgaaatagtcccgtatctagagaaatgtacaattattagatcaaaaaaaaaaaaaaaaaaaaacctaagggggggccccggtcccaatttccccttatgggggggggtttaaaaattaattgcccgctttttaaaatatttaaaaaatcagggggcc

SEQ ID NO: 8554 - DNA, 147 bp, Diabrotica virgifera
  Clone ID: pGUT2217
gaaagattagcaatgaactacatactgtcagaactacatactgtcagtgtgcgcaggcgcgcggtaaatgtacaattttaccctcaatcgattcgccgctaaagaagaatatcttcaaaaataaacctacgcattactacacccttc

SEQ ID NO: 8555 - DNA, 268 bp, Diabrotica virgifera
  Clone ID: pGUT2237
aaagatttcaacaggtcgtacgacgccgctgaagatgccgaaaggttcgccatattcaaggaaaagtacaaccaaatacaagaacaaaacaggcaatacgcagctggtaaatcaacatggacagcaggagtgaacgactttactgacagaaaacccgaagaacttaaacacctccatggtctcagggttcctgagggaaacgccgctggactccattaacctattactacctgaatgttttatacctgaaataaagtgatcaatttcg

SEQ ID NO: 8556 - DNA, 310 bp, Diabrotica virgifera
  Clone ID: pGUT2245
ggaagtctctgcggatgttgcgatgactgctacagaaaactaaatgaaggcgaagcttgcaggtcacgttttttcggaggaggtccattcagaggaaaatgtgtagacggattagaatgtaacgctgaaggaaaatgcgccaaagtctaataattatacacgaactattatgttgataaataaatgatataaatgataaaaaaaaaaaaaaaaaaaaaaaaaaaaaaaaaaaaaaaaaatcctggggggggcccccgccccaatttcccccttttggggggtttttaaaaatacaggggcccttttttta

SEQ ID NO: 8557 - DNA, 148 bp, Diabrotica virgifera
  Clone ID: pGUT2246
gcagattaacaacagatgcacttatcattataaggcagttgatggaaaaatcatctttgcttctatccatgtcgctcttccttattgcaatacatatcctattactttatgccaagcctttattgggggaagattataaggctggaca

SEQ ID NO: 8558 - DNA, 99 bp, Diabrotica virgifera
  Clone ID: pGUT2248
taggaattatgatgaatacaatcagaaatgcatacgatacagaacagagtttgacctacacataatcttttcaaaaacataatacattggtgtatagcc

SEQ ID NO: 8559 - DNA, 487 bp, Diabrotica virgifera
  Clone ID: pGUT2270
gtctcgagtttttttttttttttttaaacttttagttatcctaagggatatgctttaatttggttaaaactaagtttgacataaatattattcaattaaaaaaattaaattaatcaatatatatttgggcatagtagtaaagtcctgggccattaaaggatgtaatattgcctaccatgtttgtatcgaaatatccgccttccactattttgggggaaacagaggttccttgtcgatcaattagttgaaggccggttatgggtctattaaaatatcctgcctggggaatacgaacattgatggacactcctgttaaaagactggcgtccacaagatttttttggcgacctgtttttgaaggacaatttgtggcattatccccattggctacaacaaccaacaacattaatacgcggacaaaaaaagctttggaaacctttttaagtcttttgtttacaaatttgaagtaaaccttgggccgaatttt

SEQ ID NO: 8560 - DNA, 57 bp, Diabrotica virgifera
  Clone ID: pGUT2275
cggcacgagctcatgccgtattctggacgagctcgtgccgcattaggcgcgacctgg

SEQ ID NO: 8561 - DNA, 122 bp, Diabrotica virgifera
  Clone ID: pGUT2277
attctgcacgaggttaaatgcttttaacaatatgattgtcccattagcacagatgcccatctccatatcctcattcatgggcctccgtcagatgacagatgttccatctgacagtttgagca

SEQ ID NO: 8562 - DNA, 77 bp, Diabrotica virgifera
  Clone ID: pGUT2280
accagacagtgttgaatctcattttaaggaagtctggcaaatgatggactggtgcagctgttgttggggcgtcggtg

SEQ ID NO: 8563 - DNA, 330 bp, Diabrotica virgifera
  Clone ID: pGUT2282
gcagtacttaatacatttgtttgtaaaattttgagttttgctgttaatcattgtatatatgataaatatattattttacagagtccttgaggtcaattttgttagcccaggactaacctgagggagagaatatattaaaaacaaataaaaatttaaaaaaaaaaaaaaaaaaaaaaaaaaaataaaaaaaaggaaaaaggaaaaaaaaaaaaaaaaccccccgggggggggggggcccccccccaaaacccccattttgggggggggagaaaaattgggccccccgttttataaaccttgattttgggggtaccaaattctggggggggg

SEQ ID NO: 8564 - DNA, 428 bp, Diabrotica virgifera
  unsure (1)..(428): unsure at all n locations
  Clone ID: pGUT2288
ctctaaagcaattttcttcatcaaaaccaaaatgttttcaactgttttcaaaatgttattgttggttgcagtattaatattggttaccgtttcaccatccagtgcagataattataacaaatgtccagaaaccagccatgaacgatacctaatttaccagaatactttaaagggcagagttatccatgtacgcattccaggaacgggtttctttcacgctccaatcacttgtcttcaggtaaccgacataaatgagagttttagtacaccagttatagaagaaggtggatatggaaaggagtatgtagttttacgtattgacccagttcaatcaggagaacaactgcagtacgatgttcagatttatgttgaccaataatcaagttatctntaaataaattttttggtctgtaaaaaacctcgtgccg

SEQ ID NO: 8565 - DNA, 345 bp, Diabrotica virgifera
  Clone ID: pGUT2303
gttttgtatcaattttaaaatattgttggaagatggttgtaggtgtagcatattttctatttctagtaattttaatgggagtcgccaatacagaggcggttgtcacaaatgaagatatcagggcagcaattttacaacttgtcaatatagttcgggcgaccgatgacaaagtataaagacacgagtaccgcgagagaattctcggcgagcaattaaagaaaggcatgataaacatcgattagaggatcaaaatgttagatccgctcaaaggaaccgtccggagaatggacgaaagattgacggcactcgaaacgatgttaatgcaaacgaatgaaaaagaaaaat

SEQ ID NO: 8566 - DNA, 282 bp, Diabrotica virgifera
  unsure (1)..(282): unsure at all n locations
  Clone ID: pGUT2315
gtcaaagagataacatctcaaattccttatgagatcccaaaactgccagaaagtgatgtagcctcctcaatagttaaagaaagctggaataaaggtgttttagttactttcaaattcctgtctgatctgcctgacaccacaagagagttaacagccaaaggtattgacgcaataaaacaaaatgaagaggttaaaaaacttttaaattcaacttcatcttcgtgatttgaaagaaatcatagttattgtgttagataatttattaataaacattntctctta

SEQ ID NO: 8567 - DNA, 644 bp, Diabrotica virgifera
  Clone ID: pGUT2321
gttactgtaggcttaaatagaacttaatcctatccggtttttagatcagtgtgttttctgtatgtatgatattgtaattattttttaattaatttttatttaaagaattgcgttcattagctgtgctagtcttcgcactttttttattcactcgtcaaatgtttattgaaaataacaaaaatcttcacgattggtgtaaatccaaaaatgtaagtacattaaaataccaacaaagtcactttttctcataaatataatctttcacagtaactgaagatttttttattagaaagattgtttttgttacttttttaaattgatttaaaggctgataatacttacgtttttatttttatcaatcatcaaatgacaatttgtatttaccaatagagatgggatcggattctatggttaagttataggtcattaaaatgtattatcaaacatttagatacatttttagtataaatttggttgtgctataaaaggggttgccaaagttgaacgcagaagtttgtattattgccaataacttgtagcaaccccacttataactctttgataatacatatttttgttggttgctcgtaagagatttttgcgaaatttgtaatggcatttgacataggttcattccaacttac

SEQ ID NO: 8568 - DNA, 161 bp, Diabrotica virgifera
  unsure (1)..(161): unsure at all n locations
  Clone ID: pGUT2323
ggggcctatttcagtcgaagagaactggagcattgcccatatgacataatttttcttaatttcgtttattttgtattgaaactatattatacattcatggaagtctgtgtgaataaatttttgataaaactaanaaaaaaaaaaaaaaaacctcaaggggg

SEQ ID NO: 8569 - DNA, 213 bp, Diabrotica virgifera
  Clone ID: pGUT2326
ggaatggaaattctactcagcaaatgtgaagcacctaattttttgcatattgaatttgttttaagaattgtttaactattgaatatgctggcatactgatttataagttttaataaatgttaatactattttattctttcttgctgtaaaatatattacttattaaaatatttttaattaaaaaaaaaaaaataaaaaaaccttcgggggggg

SEQ ID NO: 8570 - DNA, 115 bp, Diabrotica virgifera
  Clone ID: pGUT2328
gcaagagatcttgacacggccggtatgctcagtctatgttgatatgggatacattccatataagcttatattaccatgccctgatcgtaccttccgtgcgcccaggactaacctg

SEQ ID NO: 8571 - DNA, 374 bp, Diabrotica virgifera
  Clone ID: pGUT2329
gagagaactagtctcgagttttttttttttttttttttttttttttaaaaggtgggccacccttttaaaattttggggaatttttcattttccaggggccctttttttggaagggggccaaattttttgggattattttttaccccccaggggggggggggttccaaaaaatttttttccttaaggggcccggggtttccccaaggggtccccccgggggaaaccagccttttttttggggttaaaattaaaccccgggggggcttttggccccccccttttgaacccccccaatttgggggtccccaattttgggggggggccccggccccaattcccccttttgggggggggtttaaaaaaaacggggccgg

SEQ ID NO: 8572 - DNA, 287 bp, Diabrotica virgifera
  unsure (1)..(287): unsure at all n locations
  Clone ID: pGUT2335
ctaaacatacgtgaaagaaaacttcattgggcaatatgtaaattaagacatttcatttccacagatcaaataaaaggggctctggacagaagtaatacatataccatcgtgtttgtaagcgtgggagactcgaattggtgtcctctacagggtaattgattagtagggtaaagctcaatagctccgctatagtaatagatagcaataaaagttaataacaaaaattntagccacctttgagcttcacattacaaaattagttagaatgttacagggtgttggataac

SEQ ID NO: 8573 - DNA, 650 bp, Diabrotica virgifera
  unsure (1)..(650): unsure at all n locations
  Clone ID: pGUT2337
ccaacaatcgttttttccgattataatgccatctatccataattcgaaaaaatatttcgaataaaagttacttatttttacttaaggaatccaaatctgcaataaaaaatgagggttcccatttaagattttaaagtaaccccacaccccacctccgtgggggtcgtgtttggtgccattcgatatatttttcaaaaatattgaataagtgtattttatagtttttcgatccgatgtccatttcgcgaaataccgtgggatttaaaatattaaatttacccccacccctctttgtgggaagtcgtgtttggtatcattcgatagattntgaanaaatattaagcacatattttttagttnttcgatctgtcatttatttcgcgaaatatgcgctnntttctagtgaagctttgggactcgcccatttccttacgcncngctganatcgtcagatttttaaatacactcttttgcatgtacttaacttaccttatgttaatatgacaatttcgagtttttaaggacatatnntttttttcggccccccttaacgaactcccctgtgttaagagccaatatatggtagaggtacatctacagggtaccaggttntctcccatatgataatctgacgcgctcgagggggggcc

SEQ ID NO: 8574 - DNA, 355 bp, Diabrotica virgifera
  Clone ID: pGUT2340
attctctggttttactctgtataataaacatgtttttaagtttttgtcttgaatgttttcatttttttcactttccgttggttcggatttgccgaacgttcggattagcggggttcagatttgcggggttctactgtatattaaaactttttctcactaaagctcagaacttatctaaacacaaaatactattgactaactacttattttataaaggtttattagatttaggtgaaacctaccggtgatattttcgactgtaattgcctaaataggctctaaataaattttttttatattttaaaaaaaaaaaatataaaaaaaacatcttttacccttcactatccttctatct

SEQ ID NO: 8575 - DNA, 308 bp, Diabrotica virgifera
  unsure (1)..(308): unsure at all n locations
  Clone ID: pGUT2341
gttcttttggctctagtagccgtagttgtcttagcaacaaccgaagtcagcgcaaagtccgttaaaggaacttccttcaaggcagtggcactggcaacacttggaaaaactcttggagaagacgtctgcgactgtgacgaatgcaccaaaacttgtgtaactgaagatccttccagcgttggaggagtttgttatgaagacgagtgttattgtggatacttaaattgattacatttttaatatctttagctaataaatattttttaatttaaaaaaaaaaaannaaaaaaaaaaaacctcgagggggg

SEQ ID NO: 8576 - DNA, 124 bp, Diabrotica virgifera
  Clone ID: pGUT2344
ccacataccaccgatgaaacccccgtatatctcccagattcagtggaatgtgcagtattttatgaatgtgataacggagatccaattaagttgacttgtgctcctggaacatactttaatatag

SEQ ID NO: 8577 - DNA, 431 bp, Diabrotica virgifera
  Clone ID: pGUT2345
attcggcacgaggacaacctcacttcacgcgcaaattatgtgaatgtgtgtatttatttttagaagtggtacctgaattaaatcaataattatgatttcaattactatttaaatacgttaaacaccattaaagatattggtccagcaaaaatgcatttattcatggatacctacctacaagaacgcaaacgttttaagaaactcttaacacgtctttccaagaaaaccaaaaatgataagaaatacactctcacatctactgccaaaaaggctgctaccgatcacagcccaaaaaacaaggaaatcatcgacagttatatctccttctgttcgtataaataggttactgtacatattacaatatttgtaaatcagtaagcaaataaatgaattgaataactccaaaaaaaaaaaaaaaaacctcgaggggg

SEQ ID NO: 8578 - DNA, 543 bp, Diabrotica virgifera
  Clone ID: pGUT2352
gaactagtctcgagttttttggtgtattttttaatgggcccgattttcctgggcccttgtggttggcgaagattcagatacatcttagcaaaaccctcggggatttttaactagggacccatgccgaatttccctaagcctctgaaaaaatcccgtatgatacactaactgaaaagtttcccgaccacaacttctggagaacaccctggaaagattttagatacattagggcccttcatcgggtgaacgttttccgtatttaccaaacgttctccgattggtaatagcccaagattatagattcatgagatatgaatgatattgaaaaatatgttaacttgaaaaatccaaatttaacctccgggatttttgaattgggggtaaacgatcctaatggaaaagggagggttatgatttttaactaaaaaaaaaaacggttttaaaggtaaacaattttggtaaacttttagtttaaattccggttttccaaaaaaataaaaatttttcagggttaaaaaaaattaaaaaaacctggttcgcccc

SEQ ID NO: 8579 - DNA, 385 bp, Diabrotica virgifera
  Clone ID: pGUT2353
ctagtgccaaatcaggaccgaattattgaagcatatggtttacctaataaaggatttacgaaattatataaaagatcttccaaaatataaagttcttcaactgaaacatctgggatttatactggtcaagcttcaattgatggtaatcaaaataccaatgattgatagcttgaataaaattgagtactgaattgttaaaaatgagttattaaaggtttaatatttataataacaggtgaaatttttaaagcaacaactggtactaattaagccggtactgctcctaaattattttgaactgatcgtaaaaatgcctatgcctgaaaatgaactgattcaggttaaatattaactggggtgacttaatgattttctagggttaaat

SEQ ID NO: 8580 - DNA, 130 bp, Diabrotica virgifera
  Clone ID: pGUT2354
cagctctctctctctctctctctctctatctctctatctctggatctatatagctctctcgggggctctctctctctctctatatagagagagagagagagagactgaaactacgcacgagagagaagag

SEQ ID NO: 8581 - DNA, 466 bp, Diabrotica virgifera
  Clone ID: pGUT2365
tttagaataacaatatatttttatttagaaaaataatagcgttaataacttccactagctggacactttttcaattggatgcatttgtccattactgtgtcagtgtcaacttcgtcataaaaggaatcaacctgctctagatatgagtccaagcatagttgccttgtttcttcagttgcaaacactacttcacaaacaaaagtcttttgcgatgttgctgtttccttaggaatatcttctttcttgaaagcttccatgatattcccaatcataaaacaaactccacagactaagtcatctggttctggtgttggacttggtgctggagttggaagttttgctgataatataataccaaaacaagcgaagaatacaataacgaatactgatttcatcttgtgtaaaatattttatttacagctaatggcaaagagaacaaaaaaaaaaaaaaaaacctcgagggggg

SEQ ID NO: 8582 - DNA, 493 bp, Diabrotica virgifera
  Clone ID: pGUT2366
aaattaaggggggtttttctttatttcctatttttccccaacgggaccgggttattttcccatttaaccctccaattggttggcccaaattgggaccttattgattttcctaagttgggaccaaattgccagcaccgggtgccccaaaattttttttggttgaaacctttttaatgaaaaaccccctttttttttcccggaatcattgggcaaatttgggtccttaaaatttcattttcccttttggtttgtcccccaaaaaaccttccttttgaaacccttttttgggggggggccaaaccccacctttttcaaaaaaaatttgccttttggaaacctttcctccgggaattttcccaccgacccatggggccctttccgggaactggggttttttcaacctgggggcttcagaatcggccttccaaagtttttaaggggattttttttgggccggccttttaactgccgggaattttttaacttgggtggg

SEQ ID NO: 8583 - DNA, 461 bp, Diabrotica virgifera
  Clone ID: pGUT2368
aaaaaattgggggggttttttaaaataaggggggtttttttttatttcctatttttccccaccgggaccgggttattttcacatttaaccctccaattggttggcccaaattgggaccttattaatattcctaagttgggaccaaattgccagaaccgggttccccaaaattttttttggctgaaacctttttaataaaaaaccccctttttttttcccgggatcattgggcaaatttgggtccttaaaatttaattttcccatttggttggtcccccaaaaaaacttccctttaaaaccctttttttggggggggccaaaacccacctttttaaaaaaaaatttgcctttttgaaacctttcctccgggaaattttccaccggcccatggggccctttcacggaactggggtttttttaaactgggggcttcaggatcggacttccaaagggtttaaggg

SEQ ID NO: 8584 - DNA, 338 bp, Diabrotica virgifera
  Clone ID: pGUT2369
caaaaaatagggggggtttaataaaataaggggattttttttttatatctaatttttacccaaagggaccgggttaatttcacattttaccttccaaattgtttgtccaaatttgaaccttatttttattcctaatttgggaccaatttgccagaaccagtttcccaaaaattttttttggctgaaacctttttaatgaaaaaccccccttttttttcccgggaccattggccaaatttgggtccttcaaatttaaattacccattttgttggacccccaaaaaaaattccttttaaaaaccttttttgggggggggccaaaacccacctttttcaaa

SEQ ID NO: 8585 - DNA, 434 bp, Diabrotica virgifera
  Clone ID: pGUT2380
gtctcgagtttttttttaatggtgctgctagttaaattctatcttcaaggattgatctaaaactttcccagtctgttagtttatttgttagtattgggttgcaatcctttctgataatcgtgtcactcacagtgagtattatgggtgaatgatctgaattcatatataatatgtataattaatttagaatagtgatccatttgctctaaaatacttatttcgtcttttaaaatacctttttctaaaccagagtaggtacacttaaaaagtttatctagaaatgaccctaaaatgcacaattttttattttttcacatttatgtaataggtaataagttttatatgtttgcattaataatgtaatgttaagttttgaattgaaaataaataagattttaaataaaaaaaaaaaaaaaaaaaaaccttgggggggg

SEQ ID NO: 8586 - DNA, 337 bp, Diabrotica virgifera
  Clone ID: pGUT2384
gtcaactttaatatgtggcggactcagcaagaacccaattttcacccacagtcaagctgacgtttgcaacttacctacggtgtgtcccaacgaagtagaatcagtccttctcggatgtgccattttgggagcatgtgcagccgggcatttcgaaaatatgactgcggccattatgagcatgggtggcgagggaaaagtagtggagccgaataaggaattggtggagtaccacaataagaagtacaaagtatttttgaaaatgtatgaagatcaagttgcatatagaaatgcaatgaactcctaattgtgtgttaataaattacttgtttttttgttg

SEQ ID NO: 8587 - DNA, 102 bp, Diabrotica virgifera
  Clone ID: pGUT2385
gaagaagtgagactggtacaaaagcatttttcaggtagttacagtaaacgggagaaagaaaaatggaaaaatgccgtagaaatgaaaaataatccctattct

SEQ ID NO: 8588 - DNA, 611 bp, Diabrotica virgifera
  unsure (1)..(611): unsure at all n locations
  Clone ID: pGUT2392
ggatagtgttaaccgttgttgtacttcttggtttagccagtgcagaagaagtttctgaaaagagagcagtcctcagaagaaccaccagacaagccctaggatccatgggaggttcatttttagcacaaactgaaaggaatattataaacaactgtaagaaaaatggactatcagatcaaggcgctgacgatctgcaggctacatacgctaaaatgaagtcgtgcatgtccggcacaaaaatttttgaaactcctagaaatgaatttattagcaaaatggaagattgcagtcgtgacgcaattaaagaaactaaatcttgtttggctaacaaccaaaaatatttcccagaattcgtcttggatcttgcaaaatcgatggttaaatatatgtacgatgacaaagatctatttagagattcagaaattgtcggttgcataaataacttgggaaggtacacagtacaagttgagtatattagatgtttaaccaccgtatctcanaaaactggagacgatgaaaatattcctacatctagggcagaattttgcagaaaattcgtaccagcaaccgaatgtttnccagacactattaaacggcactgtgtaaatact

SEQ ID NO: 8589 - DNA, 492 bp, Diabrotica virgifera
  Clone ID: pGUT2393
ataagctatatttttgctaataatatttgtttgataaaatacttactttttgaggtatttgcgaaaaaccgtctgcaacgtggttttttgttgaaaaataaacattttcactcgcaaataactcgaaaagtattgacttagtgaaaaaaaaaaaaaaaattgggggggacctttgtacccccttaaaaagttttccttcttttatttgatttaaccgaatttaatatccttttaattaatatttggttaaaattttaacctaattaatactaactacttttaaaacattttttttagaacagggccaaaatttaaattattaaaggattaaaccccccccaacccctttaaacaagccacaattgatgtctgaaaattaattgtcaaaaatttttttaactaaatccgtattttttgaaaatccaattttttaataaatatccttacattcttaaaaggttttaaaaaaaaaaaaaaaaccttcgggggggg

SEQ ID NO: 8590 - DNA, 614 bp, Diabrotica virgifera
  Clone ID: pGUT2394
cttgtttgtagctctcttgatcctttcaacagtgcttgatgcagctgttctgaaagacgattttgactacatcccggataggccgcaagatccaaaagggccgcaagatccaaaagaggtcacatctagctcttcggtggatcccctaagtcctgaaaatggtgaaattgacattctcgaaggaaatttgacggattttaacggcaccggaaaggatttgtttgtgataaaaacggttgtttatgaaattggaattttgacggatattggaaatgatactaacttcgacaatgaaacccatgaacaaatcgatgtttcatttttcgacccagcccacaacggctccatcatagacctatcccaaatcccaataccgattcaaaccaacgtcagtggagtctctatcaccggattactcccagccaacttcggcgacttgaatttacttaaaaatggcactcctacagtgcaaggatcacactttcctctgttcccgaacaaacaagtaagagttacccataatgtgagcacatctgacagagatagaacgaacgatgtattgtctggtttgccggaattgttgggcttgaaagacttcataaaatacgattctt

SEQ ID NO: 8591 - DNA, 582 bp, Diabrotica virgifera
  Clone ID: pGUT2396
tttacttcaaatcatattggaaggtaaagtgaagggcaaaagatcagaaggaagacgccagatctcgtggcttaagaacctgagaaaacatttttcgtgccgcagtttccaaagctacagttgccatttggatcgccaaccttcgaaaggagactgcgcaatcagaacaagtgcacatagacaatcttttacacaaggcttttgaaagactcatttaactagtaagtactcgtagttaatagtagattttgtttctcttgatcaactagtgttgtatctatttgttttgtatgcaagtttatcttttaatctcctaatatttgtactccattttgtatttgtgctataaaaaattgtcagtacccttcgtaaatgctctttttgaaccaatagtgttaaaacactctcctattacaggtaatatcctcatatttttgaggtccgtgaacctggccccccgaaatgcgaatattcgtgtgaaaatttgcgcatcgtttgcccatcgtttgaccatgtttgcccactaattactttttttgcccacctttacaataagagatacatacatgacataaaaaacat

SEQ ID NO: 8592 - DNA, 619 bp, Diabrotica virgifera
  Clone ID: pGUT2404
gattttagccgcagtttgtctctacgacgtatctgctaaacaaaatgactacgtgcaatgggtgagttatgatggtacaatacccgccaatgttgtggaaggaactacatccattgatggtagacaattatatattgcccgtgcctttgttagtttagatgagtctgatctttattatgacaatcaaggttacatagtaggcccagtggaagcaggagttttacaactcaatgctagttttcctgatttaacttaccatattaccgacaacattgagatcctaactgttgtggatggagccaaagtcgaatgggttagcacaaatcaaacatttttaccaaaatggttcgatagtgatgactaccatccagtgcactccaactggcatcaaattgttaatataaattcaaccatttatataggaagaatccacgactcggatataggtggtacatttggacatataccggtctccactgagttatacgaggacgaggatgtggcatactatgcttttggcgatgatgtccgcgaatctaatgtatacgatattttactggattatttcaaataataggtaacgtaaaatatacttgtaacaataaaaaaaaaagaaaaa

SEQ ID NO: 8593 - DNA, 630 bp, Diabrotica virgifera
  Clone ID: pGUT2410
gataaacgcagtttgactctacaacatttgtgatattgcaaatgacgacccgcaatgactgaggaatgatggtacaatacccgccaatgttgtggaaggaactacatccattgatggtagacaattatatattgcccgtgcctttgttagtttagatgagtctgatctttattatgacaatcaaggttacatagtaggcccagtggaagcaggagttttacaactcaatgctagttttcctgatttaacttaccatattaccgacaacattgagatcctaactgttgtggatggagccaaagtcgaatgggttagcacaaatcaaacatttttaccaaaatggttcgatagtgatgactaccatccagtgcactccaactggcatcaaattgttaatataaattcaaccatttatataggaagaatccacgactcggatataggtggtacatttggacatataccggtctccactgagttatacgaggacgaggatgtggcatactatgcttttggcgatgatgtccgcgaatctaatgtatacgatattttactgtattatttcaaataatatgtaacgtaaaatatacttgtttaacataaaaaaaaacaaaaaaaaacttgaggggg

SEQ ID NO: 8594 - DNA, 604 bp, Diabrotica virgifera
  Clone ID: pGUT2412
agaactagtctcgagtttttttttttttttttaaagggcctaaaacccaaatttcagtggctaaaattttatattttttaattaaaacaatttctgctacccacttgaaaaaaaaaaaaaacaaaaaaaaaaaaaaaaaacaaaaaaaaaaaaaaaaagaaaaagaactaaataatgacaaaaaaaagatacatagtaagccacagaggaagcaggagttttacaactcaatgctaggtatcctgatttaacttaccatattaccgacaacattgagatcctaactgttgtggatggagccaaagtcgaatgggttagcacaaatcaaacatttttaccaaaatggttcgatagtgatgactaccatccagtgcactccaactggcatcaaattgttaatataaattcaaccatttatataggaagaatccacgactcggatataggtggtacatttggacatataccggtctccactgagttatacgaggacgaggatgtggcatactatgcttttggcgatgatgtccgcgaatctaatgtatacgatattttactgtattatttcaaataataggtaacggtaaatatacttgttaacaat

SEQ ID NO: 8595 - DNA, 255 bp, Diabrotica virgifera
  Clone ID: pGUT2413
acctagagtcccaatacaactacaatctccaccaacaacaaatgccattgtcccaatactggaaccagagatacggacaacaatacccacaacattatgaagccatggaacaacccggatggtggaaccaagaatggacccaaaacttggttggacaagagaatcattatcctctcttggggcaaaatatgcccttagtatattaaaaagtattctgttctaagcatatgatttaaaataaaaaaaggcatatat

SEQ ID NO: 8596 - DNA, 456 bp, Diabrotica virgifera
  Clone ID: pGUT2416
gctttctgcgccgctaagctgcgttatcaacgaaggcagcaccattgaggttgagttcggcagcatcgtcagcaagcaattcgtcatcaaggggcaaccgccaaaacgttatgccatcaaaaacgttgatattgcctaccactgtgatgataacgcggtgggaaacacagaccggataaagctcacgctgaccgcagatcaagccgtcgcagacagcagtacgccgtacattgcaaaacttctggacagggaccacctcggtgtgcgtgtatatgatgaacacagacagaacgtaacgctggacgggacctatgagtttgcggtgaccatggaccctcagggaaacggtgtggtcaaaaatcatgctgtaccggtcagtacgaccaatgccttttcagccccgggccgctttgaaggtaacgtgacggtgaagatggatctttcgttaccgaacta

SEQ ID NO: 8597 - DNA, 458 bp, Diabrotica virgifera
  Clone ID: pGUT2418
ctggtgcctaatgctgaccgtggacgtcatggtagcttaccctcgacgacccgtgctcatacttgcgagccttattgcctactcaatatgacattacatcttacgccttttgacagcatcgacggcgcctttcaagcgcattgtcgactcggatcgataagtatcttcactgcaattgccatgagcagcaccggcctgtaccataatgagtaccgtgctgttatacaatcaggagccggcttctctgtaaacaggatctgaccaggccgttcttagactctcacctgtctgctatgctacacgacactatttacacttcgacctcatcagtgatctacatcatcttgcacaatgcgcttcacaagctggcgtagtttgagacatactcgagaatctgtagcctcatactgatgtatatgaacagtcctatggtgatccatgaactgatcatggatgaa

SEQ ID NO: 8598 - DNA, 298 bp, Diabrotica virgifera
  Clone ID: pGUT242
ggactccacgcggtggcggggctgtagactagaggattggcatggcctggggagacgagtacagctcatgtgaaactccgttggaaatgtcacgggatagtccccgtcaactatgacgatcgcgacctcaatgtcggattcaagtttatatatgttgtgccaactattgtaatacctctgtactactcacaaaattgtaggtcatccgagttaagtacggtgtaaaccagctcggtctccaactccactggaatcatctcttccatccagatatgatccaatattgataatatttttt

SEQ ID NO: 8599 - DNA, 590 bp, Diabrotica virgifera
  Clone ID: pGUT2420
aaaaaataaaacatatataaaaaattactaccaaaaccactgaaaaactagaatgaacacacaaataaacatagtataaacaatgggaaaaaagaataacaaaaccaaaaaaaaaaacaggaacaaaaaaataaaaaataaaaaacactgagtgtgtttcaaggatctacatcttatgtttttttatatatatatgtatatatgtatatatatatatatgtatgtatatatatataatatataaaaatttatacctgagtcaaatgcccgaaaagcaaagtgttaatttatatctgtaatatgtacaagtttgatattgtatctgaaccgaactgatttataaaataagaaaatttatataatatgagcaatatttttgcttttcgaccacttttgtgtaggggtggggagttcgtggatttttaccaaatttgggtatattactgtaggtaccttgggaaggtagcctatagctattttttagtcctctaggtgacccttaacctgagatatgcctctcgacagggtcaaaaatagccctttaaatgctctatttgaagagccatatctctgagcccagaggaccgatt

SEQ ID NO: 8600 - DNA, 547 bp, Diabrotica virgifera
  Clone ID: pGUT2424
attccctgcaaggaagttcgcattgaaagcttaggttgtattctgttaaataaatactttattataaaaaaaaaaaaaaaaaaaaaaaaaaaaaaaaaaaaaaaaaaaaaaaaaaaaaaaaaaaaaaaagggggggggcccccccaaaaaaaacccccaaaaaggggggaaaaaaaaaaaaggggggccgttttaaaaaaataacaattaaaaaataatagaaggggatttttaaactcaatcctaaaaatatataatattaataatacaaaaatattaaataataaaaatatcgcgaataaatacattaaattgaattcttaaaaaaacagatatatttaaaaaccaataacatttcaatacaaaaaaattatttaaaatattaattctacaataaaaattttaaactactagctcctttaaaattaaaaataataaatatataattaaaaattaataatccctgatacacaatggaccaaaaaataaactatactcttataaaaaaaaaaacaatctgttacaaaacttaataacctatcattta

SEQ ID NO: 8601 - DNA, 467 bp, Diabrotica virgifera
  Clone ID: pGUT2425
gggaacaaggccataacaggtttttcaataaattcaatggaagggtttgtgttggtggccacccacattttaatccactttaaccattggattaacagttataaagggcatttcaatagccgggggaccaaacataccttttccacaatttttcctaaaattggctatcttttaaaacttcggataaacattttctttaattccctggtaatcctttaaaaggtggccggaataaacagttttgggttttaggtggggggcccaatattttgggcaaaattaaacctggaattcggccattttgtccacgtggccatttaaaaggttggacccatatggaattcccatggtggaaacggggttttggcctttacggttttttttaacataggtccgggacacatgaaatccaggttttaaactacgtatccaaaaagcctcccttcgaaaaatagggtttttttttc

SEQ ID NO: 8602 - DNA, 623 bp, Diabrotica virgifera
  unsure (1)..(623): unsure at all n locations
  Clone ID: pGUT2432
atctccatttggcttgtgcaattttttctatgacatctgtcactttggtcctctctctcactatcctatttggtaccatatctcttcttgttatttctaaaattgctctttccatttttttaggttattctcaatttatttgcagaatgtttagtcaaagttatgaaaccatatgttattaccggcagcatgcacacaacacccgtttatatcctgtacattacattttgttctaatttcgtcactttttattcggtctctcagagttttttttgtaattcttctcagtattcttgtttctgctgtttccagccttctctctattttagctgtatcgggtcttgtttctgatgcatacctcattattggtcttatattcataagattcttcatttcatctcacagttaagatgtcggttacgccatatagtgtcaattctgctaatctatttgctctttgtacttggacatatcttgaccatcatatatagacaaataccattcttgacgaaanatgtacattatatacccctttttcgttatctaattatctaagagatttacccttaaacttgtacataacaccttgagacgtgaatctacgatcatatcacacacatctg

SEQ ID NO: 8603 - DNA, 621 bp, Diabrotica virgifera
  Clone ID: pGUT2438
cagcgccatcttcgccatcggcctgaccgtacctgttctgacaggtccaggtccagctttccaagttaccgatggagaatgtgagaatgtctcaacagacgaattggtccgccaagagcaagtaaataagggtggttttccatttgttaccaaacaggctgatgttgaatacttaggagatccttcaaaagttatttactgcgttcaagctctcagctctgatgacccaagcgttggttctattgctgaaattacagttggtggagttggtcacgatttcgtaaatgtacatttgacatctaagaaaggaggacccctacattacgatgttgaaatttacgccagggcaccaaataataatattaaataataaatacattaatcgccctaaaccacttgtgaaaatatatttatataggtaataactaaataaaggagagagagaactagtcttcagttttttttttttttttttttttttttttttttttttttaaaaaaattttttttttattaaaaaatattttcccatattttttttgaaacaaaatcgactcttttttttttttaaaaactccgggctttttttttaacccaagttttgtttggaaaaatcttttt

SEQ ID NO: 8604 - DNA, 408 bp, Diabrotica virgifera
  Clone ID: pGUT2440
ccaaaacgacgacttcgccaaaggactgttggccgtcactggaaaggaactggaagaggagaaaaccgaagcgatcaccatcatcggagcatgactagctaacaaactttagaacgttaaacaaaaagaaataagtaattttgcctgaagtatacttgtatgcttgcaagtagtgagcacagaagtagataagcattatagataaaattcaattgaacatcaggcggggtcaatcgatcaacattacatatatacatattgtaaaaaaggtactattttattaaagaattctttttgtaaaaaaaagaactaaaaaaaaaaaaaaaaaaaaaagaaaaaaaaaaaaacccggggggggggcccccccccaaattccccttaaggggggggttaaaaaaaaaagggggg

SEQ ID NO: 8605 - DNA, 109 bp, Diabrotica virgifera
  Clone ID: pGUT2442
ctcgtgccggttcatccaaagatgattaaaaatattaaaaaatgttgaatgaaataagtgtttcgtttaaatacatgttttcgtaatatataaataaataatacttgtg

SEQ ID NO: 8606 - DNA, 610 bp, Diabrotica virgifera
  unsure (1)..(610): unsure at all n locations
  Clone ID: pGUT2445
ctcactttagttttgaaagtgaccaagtgatacacagtatgcattgttcaagtataatatttgtcgccgtcctgtttgttggcggtaccatcgcacaggatcctgattgtgaaaaacaacaatattggcctgatgtctacgactgtacaaaatactacgaatgtaatactcagggtgagaaggttgaaatgagttgcccatcaggtctttactggaaccccctgcttctgacttgtgatcgcccagaaaacgttgactgttcatggactgttggtcctacggagtccactgcacctccaacacctgctccaactactgcaaacccaactggaacaacaatacctncatggcttcgatgtgacgtaaacggcgaatattttccagatacaacgaattgtcaagcattttacgaatgtattaacaacgtaaaacagcatatgatctgccctgatcctcttttgtggaatgttcatttacctggatgtaccgagagctctgactgctcgcaaattgaaacatcaacaacacctgcttcctgcacaaacggtgatatgaaagctgatgttaatagctgtcattatttctatatttgtgaaagtaaccagtgggg

SEQ ID NO: 8607 - DNA, 649 bp, Diabrotica virgifera
  Clone ID: pGUT2446
gttgccttgagcagctgcttaccagcatccagaaatcaacaatacgttgatgtagactacaacagctacaacgctcatcccgtctacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatgtgcaaaacttaactcccgttcaacgtgttcagttgctactcaactacgtcagacttcaccaacaatggaaccaatggactcatgatgtaactgccaatgaacgtcttcagaatatgttgtatcaacaccttcctgaacacttatggagctccaacgagcaaattgtaccatacatgatgaactacttcaaccaatacccaatgaaatacaacgacattatgcatgaagttatgcaaaccccatgggctcaccaacaacttatgttccacgttatgtctgaattataccagcactttcgtcaagccccatggtcccacgaacaaataatgaaccagatcatgcaacaccaatacctttacggtacaacctttatccaacaacaaactc

SEQ ID NO: 8608 - DNA, 559 bp, Diabrotica virgifera
  Clone ID: pGUT2450
ctatgttgacggattctgtctttggcgcaattgtttatctacggtgcgtttagacaaacaaaatggcttgctttttagatgaacttgtgctagaagataattgcccttttaatgctgtagcatttttgggacaatatgacagccaggacgttagtaaggagagtgtaacaccgaatatcgtgggtatgcctatgtccatggtggagttggtagctaacaatgagtatgttcgcaaaacgattgacgagaaggaaagttacaagatggaaggtgtcgatttggttgtagggagacaaaagttgcgtgataggtttgcgcaacttcgttgggcgaacattattaacagcaccctcaagaggattttaatagaagccgatccagacttctttttgaatggagctattacaaagtttgaggaaggtgagtatagacaatcattgtctattttcaggagtatacgtagtttacaacctgcgaaggatttaataacaaagaaactttgtgaaagtaatactgggggaacatcatttgcttgttataggagattgttggacaaggc

SEQ ID NO: 8609 - DNA, 382 bp, Diabrotica virgifera
  Clone ID: pGUT2451
attaaactacgaaaccgttcaacaaagatatcaacatgctcaaccacagctttaccaacaatctcaatcatactaccatagcaacgttttaccatggacacaatcatactctcaaagaaccagcatgaacccacaatctcattatagctacaatctccaccaacaacacattccacagtgcatggaacaacctggatgggggaaccaacacaatgggtgggggaacccacactacaccccgaatatgagttcacacggggatctatatgctgctgtggggcatcatataggtctagagcgcataaaattataacgctgtaactcataatataatatatataatacatctttaaaaaaaaaaaaaaaaaactcctgggggggg

SEQ ID NO: 8610 - DNA, 163 bp, Diabrotica virgifera
  Clone ID: pGUT2452
gttgattgttcggtattcggaaagacttttaaaagactttttggaaagtacgtgtgtgccgaccaaagatgttgctacaagaacttacagtaaaacagctccgtgaacagctagaggaacgggacgtggacagcagtgggctcaagatagtcctacaatcacg

SEQ ID NO: 8611 - DNA, 308 bp, Diabrotica virgifera
  Clone ID: pGUT2458
gttttggccattttagtttgcgtcggtcttaccgtcagcgcccaaaagaatgactttttgtgcgatacctgcgtaggaatagtaaaagtagtccaggactacgtacgaaaagaaattccattggaagaagttgaaaaagaagtgaaagaattgtgcaaagttttaccaggagatttggaaaaattgtgcgaggacaagttaattccagcaatcgaccaaatgtacaaccagatggaagacactcctcctagagatttatgcgtagagttggaattctgtaattaatttgtttgttagaatattataat

SEQ ID NO: 8612 - DNA, 578 bp, Diabrotica virgifera
  unsure (1)..(578): unsure at all n locations
  Clone ID: pGUT2465
attcagtccggcacgcttcaccgcgtgccaaggccgcctaccgactaaactcaccccctctttctccagccgacgagtctggaaccgcacttagcgtgcatgtctgatccgccgaccttactcttaactcacctccggcactctccgcgtgcattccaagggttgggcggccatccagcccccccacccgcacgagcattgcaccagaccggtcggtgaagcgaccgtccggcgcaatccatgcgcgggcgagacgactggggtgccctcccaccacgatggaactagcaaaacagaaccagttggtaattacgagtaacgccaatcattcctactctcatcaattcatacacactcttcatactgccctcttttgcgatccgggccccccgatatttggctttagcttatttagtgttgaggtccttccctccgccttccgacatgcttcttgtatgtgttgcccgaagctaagtctattgtcaaaggtgcctaggtacctgactgtcctttggggtcttatttcgggagcctgatattcgaatactatgtcttctctttntctcgtatccacttag

SEQ ID NO: 8613 - DNA, 669 bp, Diabrotica virgifera
  unsure (1)..(669): unsure at all n locations
  Clone ID: pGUT2470
attatgtattgtcttcatttattgagaatgcatttttaacatatataccgaattaaaacactgcattttcaggcaatattttgtttcaaatcgtagatacagatgtaaatttagactttgttacatatacatatgtactttttgaggacaatgagttatctagagagaaacaataagcaattataaaatatctttttttttaatagcctatacctagtatgtattgttaatcaccgttgctgatacgtttaagttacctttctgaaatcacattgtatacatttatttttcttaaactcagtatattcgtaagtacaaacataatgtcaattacaaacggaactaaaacgtatttttcaaaatatcctgcgaaacaaccacgcacaaccaacaagaattactaaactattacagctttctgaagattattatttaagtacggcaacactgtaaagtatcgatcttagtaaaatctctttacaaaaatcaagtggaaagtggcanaaaagtaataactacacgtttgtgccaaagaatgaagaaacatctgcaaattttatcagtatttatccattgtcaatataaatctggaacattnntttgacctatacgattttgttttaatgctattgtatacttnttggaaaaataaagattctggtgtttttc

SEQ ID NO: 8614 - DNA, 673 bp, Diabrotica virgifera
  Clone ID: pGUT2472
ctcatacctgcctagagaagataatacaataatacattttatatatttattaataatatagtaataatgttgcgcgtgcgttgtctactaagcattgtggatttggtcgatcttccgatttagtttaagaaataaaaatatatgggcaacttttttttggttttgtttcctggccttggtgtgaaaccttagccacgtaattactataactatctcgggggagtaatgtgtagtgtgtgttgagtaaatgggttgttacttagtaaattcggcttcgtaaagacaaagtttctacccagactggattcgaacttattgggttcaaaggtaggctctcttaccactgagccacggaagcttgtacccgtctttgttaagattagtttatagttggcgaagaacatttcagtaagtttagctcgcgtatttcgcctctaatcttggaaaaaatatatggacgtgtttcaaatttcaaacaaattgtttattttaagaaaaacgttacgaaaacatatttagttcaaaagtactaattcctcaatatatttcattatttgaactaacattttttttatcctgattattgatttagagatgtgtacaaatcaacaatgcattagtgaatccttcactctctcttatgtacataatttgaaacaattaatttacattc

SEQ ID NO: 8615 - DNA, 548 bp, Diabrotica virgifera
  Clone ID: pGUT2474
ctagtctcgagttgtattatcttctttttttgttgatgtatttttgggatgttttctttattattacactgttttttcaggctatattttgctttttatgttgattcagatgaaaataaagactttgttacatatacatatgtactttttgaggacaatgagttatctatagagaaacaatacgcaattataaaatatcctagcttttaatagcctatacctattaagtattggtaatcaccgttgctgatacgtgtaagatacctgtttgaaaacacattgactacattaatatttcttaaactcaggatattcgtacgtacaaacataatgtcaattacaaacggaactaaaacggatttttcaaaatatcctgcgaaacaaccacgcacaaccaacaagaatgactaaactattacagctttgtgaagattatcatctaagtccggcatcgctgatgagtatcgaacttaggtaaatctcttttcacaaagcaagtggaaagtggcaaaaaagttttaacttcacgtttgagctccagaatgaag

SEQ ID NO: 8616 - DNA, 309 bp, Diabrotica virgifera
  Clone ID: pGUT248
cggtggcggtcgatctagatataagtggatggcccggggtagcacgaattcaggatgatgtgaatccacattggtactgtcccgctctcttctacgtgatatatgataatctttatcttataatcgaagtcaatatatgatatgttgtgcttagtaatgtcactcctctataattttcacaaattggttggtctccctatttatgtattgttatgacctgtccgatcttccagtcctctggcatcttctcttccttccatatagatttcaaaagtgatagtatcttttccttcagttccttttctccat

SEQ ID NO: 8617 - DNA, 311 bp, Diabrotica virgifera
  Clone ID: pGUT2483
tctctctctctctctctctctctctctctctcactatctctctctgtctctctcactctctctgtctcgacgcgcgcgcaaagtaacgcacggggggggagaaagagagacaaagagagagagagagaataaagacgaatataagaggacataaacagacagagaacagcggaatactaggggagaggacaaatcgacaaaagagacggcgaacagaatggcagaccaaagtggatagacgaggaagcaaggagagcaacaagacgggaagaacgttaaaacaagacaaaaagaaagattaaaccaggggg

SEQ ID NO: 8618 - DNA, 665 bp, Diabrotica virgifera
  unsure (1)..(665): unsure at all n locations
  Clone ID: pGUT2488
ttttagttaattttgttgacgtcctagttatttgcttagaatccattttaccgaacctattttattgcaacattttgtgtaagaatacaaacacaatataccaagattagctagttatccaacaatttaacaaaattaaatttgtatgtatacgttgaaaaaatgtagttatcaacttgagccggcagaggcgctagtggtaacgtgctgccagttttctgtgggagttggatgtattatagtctgtagtatttgatgaaatgatgcgccgacgtttctatggttaataaaaaatgttcaccaacgtctcgcaggatttttgccgggctttcacttaatgactactctatatatgcaaaagtattagcatttaccaaattaatgttacaatatttatcatgaacaattagttaatcaagcctaaaggagagttcaatttgaaaagcttggatgtattgtttctgacgatgtttagctgttcatattgngctaacttttagaagttgtaatatctatgttgtacatacaatgaaagacgctatgtaatttattgaacattccctttaatgaatgttttttacaaattacaatatttctgtaacttattgttgaataaaaatgtgaaaattcagtaaaaaaaaaaaaaaaaatcttnagggggggcc

SEQ ID NO: 8619 - DNA, 692 bp, Diabrotica virgifera
  unsure (1)..(692): unsure at all n locations
  Clone ID: pGUT2491
actatataaatccatgtttccatgtttggtgtgtacttatccaaaaatataccctcaatataatacataagcatgtgctgtagcataccttaagtctaatagaataatgtaatatctcattttatctaaaaaaacagttattgaagttttctttaaagtattaatggctgattttaaaaattctttgaaaattcttcttctcacataaaatcctatacgttttccaattaatttattaattatactgagattatctaatgagtaagatatttagaaaaatttgaaagggctcagtttataatttccaagagtaacgttaatgtttgtctagtgtcttcttttggcatcataatcctggacggatctttgcctgtctagttatgtccttccatttagttctctcttgtgtccttctccatctgtctagtaaaatgtggaattaagaaattacactatgtagttgattacattttaaaagaaacgtgatccgtattataataaacattagtcatgaaatttaatctaataataataaaaaccaatttaaataaggttgccaattntgtgtggcaacaacctangataatgtttaaaaacatatatatgacgtctcgttttttaggttgtaaatcagttttaatcagtgtatgctacatttctgtaaacaaacatctagatgtaatctttttttt

SEQ ID NO: 8620 - DNA, 282 bp, Diabrotica virgifera
  Clone ID: pGUT250
gtgaatccacattggtactgtcgcgctctcttctccgtgatctttgacaaacttttacttattatcgaagtcaatatgatatatgttgtgcgtaatagtgttattcctctataattttcacaaatatgttggtatccctttttatgtattgttattacctgccctatcttccagtcctctggcatcttctcttccttccatataattttcaatactgatattattttatccttcagttcatttcctccacatcatataagttccatgtcaagttcgtctctt

SEQ ID NO: 8621 - DNA, 446 bp, Diabrotica virgifera
  Clone ID: pGUT2504
ctgatgccgaattagatgatactcaagcgcaagacaagactggacaaaagacgtgttacacagatgtacaatcgacaaaagggtactgaacaaaactatggctcctagatttcttcagagagttgagcctgtggttgccgtataaggcatgccagataccatagatctgaaccgtggatggaagtccattgcctgatatcattcggtacactgacgagaaattgatacacgtcactggatgagcatacgttcacattgtggaaaatgccgctagcttgtgatttggtatacgtgagccttgagatgtagctctttatccatgtaaaggatcgaactgagcttgagcatgcacatctacagcgaagcttggcatcttactaaactaatacactggcgaagctacacactctggcaaacccttacaacctcgaatcattgaagagact

SEQ ID NO: 8622 - DNA, 127 bp, Diabrotica virgifera
  unsure (1)..(127): unsure at all n locations
  Clone ID: pGUT251
tggtaatatctgcacagggacaaattcctgtggaaaggtgtccaaatgtanacgtagttacaaatttcaatggaaatgcatatttgggtgactggtacaaacaacccaaatacccacctttactgga

SEQ ID NO: 8623 - DNA, 609 bp, Diabrotica virgifera
  unsure (1)..(609): unsure at all n locations
  Clone ID: pGUT2510
cggcaccctgaacaacttgctacataatttttcaaaaatgaacagctacgtagtgctcgttgttatgtttttggccgtggcctttgctgcggaggaagaagccaaggctgatggcccgaaaacttacaggaggttgatccctgctgacgttcttagggatttccctggaatgtgcttcgcctccaccaaatgcgcaacagttgaaccaggtaaatcatgggaccttacaccattctgcggtcgctcaacctgcgtcgtttctgaagacaaaccaccacgtctcttggaattggtagaagactgtggaccacttcctttggctaaccccaaatgcaaacttgacgaagaaaaaaaccaacaaaactgcagccttcccttactgctgtccacaatttacttgtgaagaaggagccaaattagaatacccagaaattccaaccgttgcaccagtcccagaagacgctgcagcaactacaaccaaagcttaatttctacaatcaactaaattttccttcttattttttctcccttctatactcaaaaactgatttaaaaaagctcacagaaaatattnttagcagcaggtagtaaaaatttggtgtcgaaaaa

SEQ ID NO: 8624 - DNA, 679 bp, Diabrotica virgifera
  Clone ID: pGUT2511
ggggttttattatatggttctccttttcctctcaaatcagagtgaacaatgccagcagtagaagcattcttatttttgattacgtctgacacaaacatatttgtgacatcaaaagtggtcataaagcacgccttacagatgtttacattctctccgttaatgtaaagggagtaaaaatgtgtaatcattcgatttttatgtttcttgccgtcaatcttccttttcaatacgtttttttctttgcttgatattaatccggctatataggctacccttttactataatcaccaataccccacagctctttaaaaacttcttcccttttggtaacgttaattctctctttgcatttgattctacagtttgcaaggtccttaaattgtgttgctcttatctcgtgaacactagtataagtttacttatacttctgtatttaccttggtacgtattgcgccaaacaagttatattaagttatactacttttcacgtttatttagatacctatttcccagtgataatagattatgtcgacttaacctagtacttccaacaattacgaataaaaacggacttatgagccacgtttcttacatcgacgttcttggatatactgaactataatacttttcccaacaaagtaacttacagacaatgtcagatatgcacttatcgaattt

SEQ ID NO: 8625 - DNA, 285 bp, Diabrotica virgifera
  Clone ID: pGUT2517
aagaggcgtcactggcgtagaaccaagctaaagttgtaaattgtttttatattcaattgacctttatttactttagttaataaacattattccataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggggggggcgcccaccacaccaaaaagggggaaaaaaaaaaaaaaaacggggggggg

SEQ ID NO: 8626 - DNA, 293 bp, Diabrotica virgifera
  Clone ID: pGUT2519
ggacaacgggacttagctggaaaagtctccaatttacaaaagatgatgggagaacacggagcccttggcgaatggctctacgacaagaagctccaaggagcctcttcataatttcattagagttgtaaatatttttagtgcagtttttgatttgacgtccgtgaaactgtgttacgtgatatagtgatagttcttatcattttttcttttttgtaaattgtaagatggttccatttatgtattcgttatgttcattttggaaattataacagaaataaagacaacttttaatt

SEQ ID NO: 8627 - DNA, 181 bp, Diabrotica virgifera
  Clone ID: pGUT2524
gaatttaggttaccgtttttcttttaatataaaagctagactctattgagcctaggaagtatttgaataaagttaaaaaagtaaaaaaaaaaaaaaaaaaaaaaaaaacctgaaaactacttgggccccttgggcccaaattgggcccaaccttggccccttgggccaaattcggcccagg

SEQ ID NO: 8628 - DNA, 582 bp, Diabrotica virgifera
  Clone ID: pGUT2526
ggatcaccaagatatcctgacgaaattgaagaacccgatgatgttaacgtaaggaaaccaccgaagagactttcggacatacctttattggaatcagaagatgttaccaactttagcagaataacagaaatctcagacactaaagtagttactgatatcgataaagtagaaacaacagacgagagtctcttgagcgttaatagaaagatcaatttgttcctagacactgctgataaactcaccaaaactggtaaaggcccatctggtccagctcctaaagtagaacgacccgaattggaagttacacaagatctggaatcagatgagtgtcttttgagcgtgtcagaaaaggttaacaagttcataaacactgctgatcaatttatgaatgttcgggatttgccagagagaccaaaaagtcctaggtgtaagtttaataacgataaaatttcttctaataactttattaccaccgaacaaaagacaattcagaaagaaaacctaactaatgagactcgaaaagtatctttagaaaatttaaacactgtcgatacctatagaaaatctgcgcccactgatatt

SEQ ID NO: 8629 - DNA, 485 bp, Diabrotica virgifera
  Clone ID: pGUT2527
gaaaaaatagatcgatatttaaatacagcacttagaaagttacaacattttccattgtcttcaggatgacaccagtaaaacagtcaacaatataaaaatggctggaaatgcatagttgaaatttaaagtgcatcatatgcatccaaaagtgcattaacatgtcaaaataagtgtattatagccagattttgttacccgggggggttttggtgctgatgaaatcaccaatactccataaggcccatcctttgcaactcctaaagtacaacgaccctgattgggaacgacacacaatctggaatcagatgagtgtcttttgagcgtgtcaaaaaaggttaacaagttcatgaacactgctgatcaatttatgaatgctcgggattttgcatagagaccaaaaagtcctaagagtcaggataataacgagtaaaattcttgtaataaatttattaccaccgaacaaaagacaatttataaagaaaacc

SEQ ID NO: 8630 - DNA, 543 bp, Diabrotica virgifera
  Clone ID: pGUT2537
acgaggcaaaataaatcaaaatttgttttccctcttctcttgtatattatactgcgactgatcaaatgaaaaggcacgaaacgtcgtaacaacttaaccgcaaacataattgcctatgccgttatgggataacgtagtgagacatccagggaggcaaatgtagccttcggattcgatcggggcattcccgggcgcccgcatgcgcaggagagaatagaggctcttataagagagccgtccaattgacgcgacagttcgtgtgagcacatcatggcgttcacattgcaaaattcgacgattgaggagcagcggggcgttatcaggtttctgacagcggaaggtgttaaaccagttgctattcaacgccggatgtatacggggaagactgttcatttccacaggagttctgggatcaatgaatccttcggctaatcaacggcatcgttgtgctcgggtaaatggtgaatactttgaataaagacttcatttatacccacagtgtcgtttcgtacattctcatttgaacaacctattagtaactaa

SEQ ID NO: 8631 - DNA, 544 bp, Diabrotica virgifera
  Clone ID: pGUT2539
cggcacgagctcgtgccgcaataattaaataacttgctaatataaaagctctttccgtatagattattattccagaagccgatggaaattgaatgaacagtttagtaacaattgaattgttaattaaaaatttacggtcgctataataaccacaataattatgatacataagaataattatgatttttgtataaaaagacactgtacctatgtaatgtactttacataaatgaaattgaactatttaaggcctcagggatattttaaaattaaaaacaattttttggcttataaactaataaaatatctcgaaaaaaatattaaatttaattaaattatgacaacggtattgaaaaaaaaagcggcaggacgcttcttttaaaagaaaaaacttttaattgtgatgagtgattcctgagatacaaccgatcaaagttgaccggcatttacgacaaagatataaacaaaaggatcataatctttgaactatcacctttttaattttggcctctttctatacaccaattttcatatctttaaaata

SEQ ID NO: 8632 - DNA, 176 bp, Diabrotica virgifera
  Clone ID: pGUT254
cgacagactggactccactccccgcggggcgggcgatctataagattggatggccggggagctgagttcaggtgagtggtactatctgcacggggactaatacctgtccaacggtgtccacacgttgaagtatggtaaatatcgacgcaaatgcttttgtgggtgactggtgtcaa

SEQ ID NO: 8633 - DNA, 87 bp, Diabrotica virgifera
  Clone ID: pGUT2541
gcatgttggggtttttaaaggtttcattggtactctgaagtatttgagggtctatacatttaaaatctacagctggagaaggaatgt

SEQ ID NO: 8634 - DNA, 98 bp, Diabrotica virgifera
  Clone ID: pGUT2553
attcagccttaaggaaaataaaagtcttaattatttaagtgaactaattagtatgttaacatgtttctctaataaacatcttcgtttttctagacagc

SEQ ID NO: 8635 - DNA, 522 bp, Diabrotica virgifera
  Clone ID: pGUT2565
ctcgagtttttttttttttttttttttttttcccctgggtttccggggtttttaattaaaaaatttttttttttttttttccaatttaaaaagccctaaaaattaaaaatttttttgggaaaataaatttttaaaaaatttttttggaataaaatggtttcccgttttaaaaatttctaaatttttaaaaaattaattaaattttttttttaaccattttttttaaataaaaatttttaattttttttattttaaaattttttggggggggccctaaaaaaaaaatttttttaaaatttaatttttaaaataaaattggggttttaaaattttcaatttttaaaaatgggtctaattttattttcatttttaaatatttcattttttaaaaaaatttttttaaaatttttatttaaactttttaaatttaggattgggggcatactgagctttcaaaatatggtttttttttaaaatctttttggggtaaaaaagggatttgggccctttttttctccccct

SEQ ID NO: 8636 - DNA, 279 bp, Diabrotica virgifera
  Clone ID: pGUT2570
aaaaatgatgtgctcgagtatgcaggttataataagtcttattattaatgggaaaggtgcagctatgacaaattgcaaatttaacccggatacaaacggtacaagtcattaccacccttccacactttgaaaacgaagaaaatttccttcgttcatcatacaaactttttttaatattctttgattatcagatagatttgttaaattagaaaaaattatcagttactagcataaatattatccaccttcaacaattaatatttataaattaaggaaaac

SEQ ID NO: 8637 - DNA, 522 bp, Diabrotica virgifera
  unsure (1)..(522): unsure at all n locations
  Clone ID: pGUT2572
gcgaaactgcgacaaacgttggtaagtctctagagtgtgcaacaagtatggcgacggtatgtagagcccagtctacttactcgaggacctggttcaggtcgaggcagaattacaacagctagagataaccattttgtcgtttatgacattatccacaaaaaataagaaatataaacataagtgaatggaaagttaggaggcaactgcatgctgctagtttatcttctcgaactagagaaactggatagctgctttcccatgaacaccgaattgccagattgagttttgcacgagaacacttggcctcaacaagatagggttgaagtcgtgtattattattgtgttccgatgaatcgagattttaccttatgggaccagacaaacgtgtaaagcctgatttatgttaggacggngacgtggacgacacggctgtcttacggngcacgttgaagaatcctctgatatgaaaagcattggctagtttatcatacaagggaatggggcgacaccggggacgtgcgc

SEQ ID NO: 8638 - DNA, 352 bp, Diabrotica virgifera
  Clone ID: pGUT2581
gagaagccctataactaccgacattccgaggcctacacgcattgtcacagatacgggtacacatccatcttctgagaagacacctgcagcaaccactttagtgccatccagtactggtgcagcttattcacgatttatagcttcggaatgccttcttccattactaatgatagttattgcattgaattgaaataaaataataatcagtttaaaaaaaaaaaaaaaaaaaaaaaaaaaaaaaaaaaaaaaaaaaaaaaaaaaaaaaaaaaaaaaaaaaaaaaaaaaaaataaaaaaaaaaaataaaaaaaaaaaaaaataaaaaaaaataaaaaataaaattggggggggggg

SEQ ID NO: 8639 - DNA, 556 bp, Diabrotica virgifera
  Clone ID: pGUT2584
cgcctctggttcatcttgtttcaaaatagcgccttgaattgaaatgtttgagagttaacctcaaaatttagtcaatctgtttaattttataagcgaagtgatattaatttcttatataattatgaataaaactgtagatattgataactaaacaactcattctatagattatcgtgacttagaaactatcgtgacaattactaaggaattaactagtttattattattgttttgttgcaacttgccaaggttcgttcgtaaataaattaacagagcgcacaagaaacaagtagtttcaaatcggtagcggaaaatgtcttttctaaagaaaatcgtgtttcctttgtatgtcgggtttgtgatattaaatgtctattctttgagactgcaactcgcgttgaatgaagtttctgagaggcctaacggggagatgttcaaccatctgaaggtgtaccactattttttcctgaccaattggaattttatgctccaaatcttcttcatttcgctagcgggcctatatgaactctcaaaatttctgagcttaccattaaaa

SEQ ID NO: 8640 - DNA, 407 bp, Diabrotica virgifera
  Clone ID: pGUT2586
ccgcgagggtctgcagtcagggcatagggaaactttttgcttcgctatagatttaaataccacaaatctcaatttaaatactattggaattgttgaaactttcgcatttaaaatctaaatgaactctactaatatactgttagactagccggggtttcctatgcatttaactctatatattaaataaaatcagtgtgtatttgttttgttattaagtgaaacacaactgtagtgtagcagcagtactgttattgatactgctcagtcttctatgtgttagaattaggttatagaatgctcgacaacgtgatacatcaaccagggaatttatacagtcactcatgtgtggtttttgtgaagattttgcgttacgtgcaccatcatggttatccttcccagcgttgaca

SEQ ID NO: 8641 - DNA, 330 bp, Diabrotica virgifera
  Clone ID: pGUT2587
agataatcatttattcgaaaacaacaatcaaaattggcatgaaaactcaaaaatcggtaataaaaagaaaacaaaatttagtacacacgtggtactctatggtagatatgtggctgtctcaagctcaactgttgtactggagagaccaattggttaagtgctgattgtaggggcaaaactcctgtttggagtaatagtacaacttgctgatggattacttgtagatgagcgattaatacttgaggaacaagatctccttgctgagccaattggaccaattggatgaaaatcatgaagctggaggaaacaaggttatggggaacaacgaaa

SEQ ID NO: 8642 - DNA, 545 bp, Diabrotica virgifera
  Clone ID: pGUT2594
ccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccgccttactaaagtgctagatgttacaagggccgtgcttactaaaatcgctcaagcacttaaagttgttatagataaagttgctgaacaaagtaatgatgctggaaagaaattggtttcctgtgtcgaacaacacgaagctgatctcgtcaatatccgcgtcgctctcgtcgaaggtgccggcaaatgcgtaaaagatagcgtcgtcgctttggttaacactggcgcacctttgctcaaagatctaactgaaatccataagcaagcaagagacgccgccgaagaaattgacaattgtgaaggagataatgcagctggtttgctctgcgtttttcaggtcgccatggatatt

SEQ ID NO: 8643 - DNA, 336 bp, Diabrotica virgifera
  unsure (1)..(336): unsure at all n locations
  Clone ID: pGUT260
atctttaaacaatttggttaggtcaacatatggaggtcaagtcgtcgaatgataagtacaaaactataaatttaagactgcttgtatattaaacatttttgtatatttttctgtaaaaacgtagtatttttaaattattagatgaatattaataatactgttttatttttttaaattattgtaaattttcttattttttcaaataagataaatttntaaatttgcctgcaaaatgtatttttcagaaagtcatatgtctgttgtcatgtatataaaaatattctcgttgtctntatnttaatgtatgcagctatgtgatattctaagtgatgccaa

SEQ ID NO: 8644 - DNA, 439 bp, Diabrotica virgifera
  Clone ID: pGUT2605
cggcacgaggtctcgagtttttttttttttggttaaattccatatgggttattaaaaagagtcctttttaagtttttaaatttaataaactaggcctttatatataccgcccccgttttgacttccgtaaaagggatcccagttctttggataatgggatgtgggaattgccgatgccattatggggccaaggtttacgaccccggccccaaaagagctgcccaaataaagaggggggttccacttttccccgttgggtagccaaccgatccttacaggacaatggccttctgggttgaaaatgcccataaatggtggctggtaaaatttaatccattcaattttggttccattgaccccagtctgtttctaaaggttctttgtgagcgtggttatactctgcggaggacaagggtcgttcgacaatttttggggccga

SEQ ID NO: 8645 - DNA, 167 bp, Diabrotica virgifera
  Clone ID: pGUT2608
tccacttgcagatttatgcaagaataaactgattccagcagtctacaacatataccaccgatttgaggacgcctcgcctgtagaaatatgcacagttttagacttatgtgagacaaattaatatgaaagtcagaataaactcaaaagtttaaaataaatttttgaac

SEQ ID NO: 8646 - DNA, 563 bp, Diabrotica virgifera
  Clone ID: pGUT2609
gaaagattgaggaacgaactgagaaacaacatcacctaccaattagacgatatgatcagtaagaattacggatcgcagacgcaaaaagacggatacttgtactctgtcggatctaacggtgccatatcgacagattacaattacggattgagagatatggaaaatttgaaggagcagatccaaagaaatttgattaataaattggaaagagactttgaatcttccagaaagagttggtcttcctcttcctcgtacagcagccagtccagctacggtaacacctacggttcagctcaaccagcttattaccagccaggtgtcaaagcaggatacaattcaggcagtgaatacaattcagccagtagatataactcagccagcggatataacacagcaaatcaacataactcagccagcggatacaattcaggtggcaccacctacagcagcggaaacatggcggagttgcagagacaacttcaagctgatctatcgagacagcttaaccaagcgttaaaccaagagtcgcacagttcatacagctatactcctcaaaattacca

SEQ ID NO: 8647 - DNA, 117 bp, Diabrotica virgifera
  Clone ID: pGUT2611
ctcaaaagaaggttgtacgtcgtgtacgtcgtctcaatccattgaccaacgctaaggccatgcttaagttgaatccatatgctgctgtactcaaacgtgaagccattttgaagaatc

SEQ ID NO: 8648 - DNA, 88 bp, Diabrotica virgifera
  Clone ID: pGUT2616
aactctctatctctctctctctatggatctgtctctatctctggggaacgggctaccaaaatctaacacgcgagaagaaacacacaac

SEQ ID NO: 8649 - DNA, 196 bp, Diabrotica virgifera
  Clone ID: pGUT262
atgtgttctaaaaaagcctggattcgtccacctccgtaggtctatccgacaagtgatgatttgacatgctcctatccatcactgcatgtgtgataaacaagcttgctatcatctgctgtggtctcctagtgggcatcacttattttatgaatgctagggtaccgctgaagtggatccctggaatgtgtatatcctc

SEQ ID NO: 8650 - DNA, 331 bp, Diabrotica virgifera
  Clone ID: pGUT2624
atctgctcaaccatggacctacagccaaactcaacaaagatatgaagctgcccaaccatggtcctacagacaaactcaacaaggatacgaaggtgcccaaccatggtcccattatcaaaccgtttcacaaacatacggaaatccattagctcaatactattctaatcaacaaaaccaacaaccatggacccaatactggaaccgatatggacaacagtaccaacatcaacaacagtatgttatgtaaaattatttatttttattaattattttaaaaaataagtgagtcacattttgttatatatcaaatatatacaaataatgatttgcc

SEQ ID NO: 8651 - DNA, 114 bp, Diabrotica virgifera
  Clone ID: pGUT2625
gaacaaggttacatcagagttgcccgtggtagcaacttatgtggtattaacctcatgaactcgtaccccaagttgtaaataacagttaatgaaaagtgatatatttataataat

SEQ ID NO: 8652 - DNA, 313 bp, Diabrotica virgifera
  Clone ID: pGUT2631
ctttttacctggtttcgcgagaaaaggtattagaagcaaacgatcagtagacgatgaggaagaaaatgattctgaaagaactaagagaaacattggatttttaccaggttttgctagaaaaggaatcagaagttaagctgaatgatctttgatttcaaaatgtactaactgttaatatgcaatttcaaaaaataccaaaaaattttcacatgtaaatgtatttatttctagattagggatttgtgtataattttttagataataaatcttttgtaatatagttacaagctggggtcttattggtgtaaggtac

SEQ ID NO: 8653 - DNA, 95 bp, Diabrotica virgifera
  Clone ID: pGUT2633
ctgtcattgaagtagattcaaatcgaaaggttaccagagaaaatcttgaacgtgtctattcagatcgagaagacagtacccgacattagaccact

SEQ ID NO: 8654 - DNA, 127 bp, Diabrotica virgifera
  Clone ID: pGUT2638
atttccagtcagcttctttagagcaaagcgcacccgttattttggctctcttggaagtttggaatggtaacttctttgaatccaaaacaaaggctttttttccttacaaccaatacttacataggtt

SEQ ID NO: 8655 - DNA, 514 bp, Diabrotica virgifera
  Clone ID: pGUT2645
gttaagttgggagacagtgttgaaaagagcgaacacgagtttgataacgtagaaaatcaaattaagggcctccaggaatctttaagtcgtatcgacagagttaaagaagaaatttcagaagttattgatagaaaatcagctcaatgcgaaaagaatctttctgagttgaaggaaattgtagaacaaatatctgcaaaacgcgatcaaacagacaaagatcttcaagccagtaaagaagcttcaaaaacaaggatagatggagtttacgaagaatgtaggtcttcaattgagcatattaatgccactttgggagaagacagaaaattaattgaccaaatacaaagtgaagataccaggatcaacggtgttattgataatttaaggaaagaaatcggaggccacaaggattcgattcaaaacttgaaagcctcataacagaaaagagttttgcgtgtgaagctaaagcaagcaaaaccgtgagcttattgatgaattgaagaaaaaggtaactgaa

SEQ ID NO: 8656 - DNA, 247 bp, Diabrotica virgifera
  Clone ID: pGUT2646
ctagtctcgagttttttttttttgttttttggaaattaattcctttagtttttaaaaattttcccctttaaataaccggttttttccacctgggggaaaaatttcagggggcaaatcccccaaaattggttccccgggcccactgggagtcaccctggttaccccgaccctgttccccagaatttttaaccccgtgcccaatattgccccaagtgccaagtcagggccctctaaaaaatggcccctt

SEQ ID NO: 8657 - DNA, 200 bp, Diabrotica virgifera
  Clone ID: pGUT2656
agaggctcgtagcacgatatcggcaacgagacggacacgagtgctctgcgctctctctcacgggctcggagtctcactagctctctctctctccccccgcgccccaaaccgcacccgggaagagagagagagagagagagagagagagagagagagagaaaaaaaaagaaagcaaaaacaaacaaagaggaagagaaaaa

SEQ ID NO: 8658 - DNA, 185 bp, Diabrotica virgifera
  Clone ID: pGUT2657
ggcactggttcaacaactgggggaacgacgaccgaaggaacacaacccccaaaattttaatcaaataatgataataaagatatgcccaaactttaataaaacttgaaccattaaaaaaaaaaaaaaaaaaaaattaaaaacctggggccaaattgggaacaagttttggccaaattcggcccggg

SEQ ID NO: 8659 - DNA, 354 bp, Diabrotica virgifera
  Clone ID: pGUT2658
ccaaaaactacatttagaaaaattatttgtttggatcattgtgttggtattttgagatacattgcctgcgctgatggtcaaaaaccccttcgtcgagatggagatggacttttaggtaaacctcacacccattacgagagaagagtatttaaatcagaatggttacatttgggaggaaaattctgtgcaaatatacgcaatgaagtttctaccctagcgagcagaggcgttagcaatttagaaaaatatacatcagagcatgaactacacgtaaaatcaacgtgtaagaggagaggaaggtattagaaaaaaagttgaagcaaatgaaaaaaaaaaaaaaaaacccggcccgag

SEQ ID NO: 8660 - DNA, 385 bp, Diabrotica virgifera
  Clone ID: pGUT2659
gttttacatagataataacaaataacaatcatgatttttaaagtatttttgtttgcgttgttcgtagcagtaataatggcggaacaaactgcagaagaggcatggccacaatataagaaagatttcaacaggtcgtacgacgccgctgaagatgccgaaaggttcgccatattcaaggaaaagtacaaccaaatacaagaacaaaacaggcaatacgcagctggtaaatcaacatggacagcaggagtgaacgactttactgacagaaaacccgaagaacttaaacacctccatggtctcagggttcctgagggaaacgccgctggactccattaacctattactacctgaatgttttatacctgaaataaagtgatcaatttcg

SEQ ID NO: 8661 - DNA, 388 bp, Diabrotica virgifera
  Clone ID: pGUT2661
ccagaatgctaacaatccaagaatgcatttcgaccaagtccaatgccctgctgaaatcgttgccagatctggttgcagtctttaaatataatataattatttgttttaaaacaattatgttttatttaggtacaaatgaaataaaccatatgcttgcatgtcaaaaaaaaaaaaaaaaaaaaaaaaaaactaaaaagtaaaaaaaaaaaaaaaaactttgggccaatttttgcccaacttttccccaaattttgccccaggggggggcccgaaacccattttccctttttggggggggtttaaaaaaaaagggggggggtttttaaaaatggactccattaacctattacttcctggatgttttatacctggaattaagtgatcaatt

SEQ ID NO: 8662 - DNA, 75 bp, Diabrotica virgifera
  Clone ID: pGUT2666
gtcaaattacgcagcgagaaagagtgctagattcggcgtgaccacagaagttcagcccactgtgttgcccaagac

SEQ ID NO: 8663 - DNA, 367 bp, Diabrotica virgifera
  Clone ID: pGUT2673
cttttaaaattaagattttattgtgaaagagagattgcaaatcaatggggggtaaactttatttgatctggatgcaaagttatgctctgttcgtattcttgtcccactttcccccaagcctaataatagtttaggctgcaacgtcgttggctatttgagtttatgcagacgtcctctacaagagcaccaagagtatcaaggagtatattcaagtgaccaataaacgtaaccatctggtccattcaaacttctatactaggcaagtatatattctttggtactacgtacaatcggattttcgtctataatctgtgtgagtggcatcaatctcttctcgcttgccttatgttttgcaactgataaattt

SEQ ID NO: 8664 - DNA, 515 bp, Diabrotica virgifera
  Clone ID: pGUT2675
gccaatttgcatgcctgccaaaggcagtagatcaaagtaaatagtggtgatgactaggaaataagatactgaaataagaatagatgtattgaaaatagataaagaagaataactgataaaaacaaaacataccatgggcgccagaagagagtatcgaccacacttccaggtatactacactgctgcaaaatatagtaaatatgtaaatacaaaaagaaggaaaaatgacataatacaatctttccaattaaatcttaattgtaaatttattaagtgaatttagtatcttttaattattccaatatctataagtaatagtcattcagggaaaatcctaatcctaattttttttggttataataaatttaaaatttcttttgaatgcttccaacatcattaatatcccagtttctttttttttcttttctttgactttttcgtacacttggaaaattgaagaaaacgggaattgtttttaaccactcacgtgaaaacttaaaaaccttttaatacca

SEQ ID NO: 8665 - DNA, 545 bp, Diabrotica virgifera
  unsure (1)..(545): unsure at all n locations
  Clone ID: pGUT2679
ctgaattaggagttccatcacataatcccttcgtcgttattagaaacgtatcatggactggatcaatcggtgttgcaagcacccatatcgaactcaataccaataaatggtatggtcttgcggattgggatatctcagctaagcaaatcaatgacgacgaagatttcgaggctgtctttgactataccacatactggcccagttttagaatcgtaggcaactacgaagcaaccgttaaagagcttttccttacacagcactacaaaggaacctacaacataaccatgattaaaccaaaatggactggaagaatcagcgcacaaaaagtccccaccgtcttaacacctaagcccattgtagacagttttaccgtcgactggcaagttgcagatgtaaaatgcaaaatcactggtatgggaataattggagacacttatgctctcgctattcaagaaggtattgaaacggccctcaaccatggtcttatcggaaataccgtcggagacttncttaaaatgagattcaacactgtctggtatcccact

SEQ ID NO: 8666 - DNA, 498 bp, Diabrotica virgifera
  Clone ID: pGUT2692
ctcgagtttttttttttctttttttgtgtggggctttttttaggggggtgggtgttttttaaaaaaaaaaatttttttgataacccccccccaaagaacaagagggagccccccggcgagcctaaaaaaagaaaaaaaaatttctccccccccggggggtcccttggggaaaggggggggggcccccccccccggggggggtttaaagaacccccgggggagggcgggtgggggggggggaaacccccctggggggggaaaacccccccgggggggggggaaagggggggggggggcaaatttttgggggggaaaaaccttttggggggaacaaagggccccaggttgttgcggggccacctgcgccccgcgggttaaaaaaagggggggccctttggggaaaccccccccccggggaaaaaaccccccccccccggggaaaaaaaaaatttttttgtggcgccccccccgtgagaaaccaaaaaataaccttgtttt

SEQ ID NO: 8667 - DNA, 253 bp, Diabrotica virgifera
  Clone ID: pGUT2699
agatcgggtgtatgtctgtttcctatgctgcgagatttaactcttctacgtttgcttatagtttttcgtttgctctctcaagtgttagtgtgatttcttcaaaaaaaaaatgaatgagcgtaattctgccgaaagacgccacctcgccgccaattcccacagggatttcaatcacgtggccgtaccataggttttaagtagctcctgccccgtatattccttctcttttccaaagttcctttagaaagatatc

SEQ ID NO: 8668 - DNA, 525 bp, Diabrotica virgifera
  Clone ID: pGUT2705
ctggagctttgttagattctatccttaactactttgacaataaaataaacggttcagtatcccaaaaattcaaaatgtacagcggacatgacctcaacattgcctctatattaagcgcgtttggtgcatttaatccaccctatcctccagatttcgcgagcagtatatatttggaattaagaaataattcggggagctattttgtaaacgcgtggagcaaagatggaaccaacttcaaaaaggtttctataaagggatgtgctttggattgtcctttagatgaagttagacaaagattggatgggatagtacttgacgttgataccaaagtcaaagagtgcaatgctaaactggaattcgaaaatgttgatgtagaaaatatgtacaaaaagtttacccaaactggtgaaatggaacgacttaaagatttattttaaaataaattatacaaatttggattacatactgtaataatacattataaataataatttgtgaaaaaaaaaaaaaaaaacctccgggggg

SEQ ID NO: 8669 - DNA, 199 bp, Diabrotica virgifera
  Clone ID: pGUT2708
ctcgcatatgcagatattttttacggagtttagaagaaaaataaaaatactatatcatatcagtaaacaaacctacataacctgatgtggttattacaccaattctgaaccatcatacaacgttattcaattaactatcaaataattcaacaagatgctagatgacccaaatttatttaagttgaatctcgtgccgaat

SEQ ID NO: 8670 - DNA, 523 bp, Diabrotica virgifera
  Clone ID: pGUT2711
gctagtggagatcacagaacgacattcactgatattctgatgaatatagtagggatttttatgtggatagctgatggagctacagctcttcattattggcttgggtacttgtccgaatacaaatacacgacaatagattctgaacgacaagttggtttggcgttaggagcgatgtgtataataaatggagcggtctatcttgtagacggagtactttccgcaatctttatcctcaaagccaaaatgcaataactttcatcgtaatataaatatatttatttaggttatatactttactttaagcagctcaagtataccgtgacatcccactcatacatcaatgtctataattgtttcatgacaaatcatttaatagtattttaaagcattcattcgttcaacacctttttttacatttttcaagtattatatcaatctctctaaagaattgtttggctattaaccggattcaatccatatagtttcgtcaaataattatgcgctttaataactaatgtaatta

SEQ ID NO: 8671 - DNA, 134 bp, Diabrotica virgifera
  Clone ID: pGUT2719
accctccttgtcagggcatgggagcccctaatgtattcaccaatgtagccaactttgttgactggatcaatgaaaacatttcacaatagaattgaataatttttttaaaatatatattaaatttattatttttt

SEQ ID NO: 8672 - DNA, 307 bp, Diabrotica virgifera
  Clone ID: pGUT2720
ttttctttttattattgatttttgagttttcatgttaattttgattgttggtttcgaataaatgattatctgttaaaaaaaaaaaaaaaaaaaaaaaaaaaaaaaaaaaaaaaaaccccgggggggggccccccccccaaatccccccaaagggggggcttaaaaaaaacccgggccccgttttaaaaaaacgagtgtctgggcaagagtctacgccggggttaaatcgtcaatcacagaccaggacctatacaatccaaataataacatgtcccaccaattagaagaaccccttttttggtaacct

SEQ ID NO: 8673 - DNA, 313 bp, Diabrotica virgifera
  Clone ID: pGUT2721
tcaaattggatgcaagccgggttgcaagcgtgtaaaagaccatgcaatagacttgcatgaaagtcttgcatgcaagaaattgcagcaagttttcttgcaagctgtaaagcggtctttaaaaacaaaagtatttgtttttatactggggtacttatatgtcaatgggtacactactgattgttggggcaagagtctactcgtggctaaattgtcaatcaaagacaaggacctagccaatacaaagaagaagatgtagaagaataagaagaaccctttttttggtaacctaaaaatctgacttgtttttctatcg

SEQ ID NO: 8674 - DNA, 266 bp, Diabrotica virgifera
  Clone ID: pGUT2723
ctcgtgccggaaaatagtgatgttagtgaaaaagaaaggactgatactcgtcaagaattatgataaatagaataaattatgtacatattttttaaattgatttgtaagtgatatttacatttcttaagttgtatatgatttaagttaataaataattaagtctaaaaaaaaaaaaaaaaaaaaaaaaaaaaatctggggggggggccgggccccaattcccccttttggggggggttttaaaattccaggggcgggtttttaaaaa

SEQ ID NO: 8675 - DNA, 357 bp, Diabrotica virgifera
  Clone ID: pGUT2724
ctcaagtacagtcggttggatacgatactgagatcattgatctgagaaatgcgagatggactcaaccatgtcaagcagaacatcgcgcaactttcacagaaaacgcccacaacccaaggatgtccgacagtgagctgtatatctcttacggctgtactagccattgcggctgtacagttaggcataattttagcctataatatttatagggataacaaggacagcagtaacaagaaattctattagagtgtatgcggatagttcttgagattaaatttttgtgttaacagtggcggggtaattaacttttttaggggcattttgacatttttaccgaacgtatttattatgttaaca

SEQ ID NO: 8676 - DNA, 260 bp, Diabrotica virgifera
  Clone ID: pGUT2726
gtgcctggatattaccaaagacctatcacctgcttactgctaatcgatcaaaaaggaagcaccagctcaccaaaaattatagaaggtggatatctcgacacttttgctgtagtaaatatcacttccacaactgcgcaaccagttagttactatgcaatagtatttattgattagcctattttagtagtatttagctatatttatgcagaaatattatttatttaaatgaaaaaaaaaaaaaaaaaaaaaaaaaaccctgg

SEQ ID NO: 8677 - DNA, 256 bp, Diabrotica virgifera
  Clone ID: pGUT273
gaaattcccgagtatattcgttccgataatagtccataaataacctgaatatcgtaaactctgttctggggcatttattgtatctatgaattgtctacatgcaagtggactgttacctgaatggtatgtcaccacttccacacatatcttggttccaaattagggcgttgttcactgtgtcccctggtaagatagtatcctacatgattaattcttcgagcccctagtacacttaccatctgtgctactacgtatt

SEQ ID NO: 8678 - DNA, 244 bp, Diabrotica virgifera
  Clone ID: pGUT274
tctcaatttattacattctatctgtatcattgaatgcactcaaattatgagtatcattatgtcgcggactggcggtgtcggtcactggcatacggcacaaagacaacaaatctgggactgcgtctccctctctggcacctccgaaggtagatgggtggagtacgtccatcatcaccacaagcacgatgtgctggctgcctatttagaatacgcgctccaggtacatgtacggcgcgtggatttt

SEQ ID NO: 8679 - DNA, 266 bp, Diabrotica virgifera
  Clone ID: pGUT2748
accaaaaccgccagaagtaatgggtggcttccaaaaaccgtatggagaaacaaatatttggccggggaaagcaaaataaaaggatacaataccacagtaagaactaatcctaacatatgcagcggagacaagggccggataccagaaagacgaaacaataaatcaacaatatcgaaatgaaagtattaagatcaatagcgggcatatcattaagaggacagacaaagcaacagaagtatacgaaaacgatgcaattacaggtggat

SEQ ID NO: 8680 - DNA, 348 bp, Diabrotica virgifera
  Clone ID: pGUT2749
tgaaatacaacgacatttttctggattttttgcaaatgtgtggggggcccaacaattttttaaaaattttataaaagagggaggccggggttaaaaaaaacggggggggggggtttaaaaaaaccaaccctctttttcagggcccctttctttgaaattttttttggtaaaaacccccacttttattttggggggaccggggccgcaaaatacattttaaaaaaggtgtttttcttaaccaccgggtgcacaaaaaaaaaacctggatttttttacgggtacaaaaatcgaacccttgggcaattattccgaggggggtaaaaaaaaaaaaaaagggggattttttaa

SEQ ID NO: 8681 - DNA, 252 bp, Diabrotica virgifera
  Clone ID: pGUT275
ggcgagttcagtacgacaataggcggaatccataaggagactatctgtgtgttggagcggctcgctctcggtgactcgcaatccggactctctcaggcgtgttgagtctctactgctaggtccaacatacgtaacggtgggaatacttctcccatatgagcgatcgccgatgggttatcggtgtagtacatctatatatagtactagcacttagtgcgcgcgaccatattagacaacgcccaccatgtatct

SEQ ID NO: 8682 - DNA, 288 bp, Diabrotica virgifera
  Clone ID: pGUT2750
attttctcccgaagcagtgctggaagtccgctctggcagcctccacactatcaaatatcatcatcattctcctttgccttatccctatgcggggtcggcttccctaattacatttttcacataattctatcttgggtcatatcaatattaatcccctttaccaacatgtcctgcctaatcgtctccccccatgtcttctttgggcttcctctcctactcttaggaatctgcacttcagcaattcttcgtattgggtgattaacgtctcgacgttgaacatgaccaaac

SEQ ID NO: 8683 - DNA, 299 bp, Diabrotica virgifera
  Clone ID: pGUT2758
catggtcttcttggagtatcccctctccttaggaaccttaaccttcctaaaattttcaactctctcctgtaaatttaagtccaagccaatgaggaaatccttatccggtaatgggataattggtggtggccccggggcctccctttcttgacctttacctttccaattttggttttccaacctaaggttcctgggaccgtcctctctttcctttcggttttcctccgaatccttccaaccatggttttcaatggaattaataataataatcctaaggttgctcctggaccctttcctaa

SEQ ID NO: 8684 - DNA, 287 bp, Diabrotica virgifera
  unsure (1)..(287): unsure at all n locations
  Clone ID: pGUT276
gaagaggcaatagccaaacgggacactcatacagttggagctcaacgctctcggttccgcgcaaaccggattctataataagtgttgagtaactagtgctaattctatttatgtctacgtgctcatagtgcatttattgagctatcgctagtagactttcggcgtccaagatatctatattgtaattgtgttgagtaaatagacttagtgaaaccgttcttttcgcatattacatttgtcncaaagctttgggtggtccttcgcataagtctaaagtaagtgaaacc

SEQ ID NO: 8685 - DNA, 285 bp, Diabrotica virgifera
  Clone ID: pGUT2760
ttgaagaacacaatgcaagataccaaaatggagaagtgtccttctacttggggggggagcacccccccacatttgactttagaggaatttaaggctatacttgactcccaactcattaacaagcctaaacgaaacattacatcccgatttgtatctgatcctcaattgactgttccaaaatacaattgactggagagaaaagggggcagcttcttccataatggaccaagggcaatgtggatcatgtttggcatttaatgcaactggtgcttttgaaagacaaat

SEQ ID NO: 8686 - DNA, 129 bp, Diabrotica virgifera
  Clone ID: pGUT2761
aaaaacctaaagaataataatggtttaacggtaagaaattaaaataatattttaattaaacctaggttaggccctaatgggtggaatctaactttaaaaatcctggttaagttaacactctaaataact

SEQ ID NO: 8687 - DNA, 341 bp, Diabrotica virgifera
  unsure (1)..(341): unsure at all n locations
  Clone ID: pGUT277
gagagagagtgagagaactagtctcgagttttttttttttttttttattaatataagttcaatccagtgtgagaaatgatcaataactactaaataacttttcccagcgaattctaaaatatcagttccaattttgttaaatctaagtgtaggaactgagtgtggtaggagaggttctttgtaattggccggcatatatttttcacaaattcgacatgatttgataaacgaaactatatcatttgttagattaggccaataaaataatttccttgttcgattgataaatnttttttgttttttttttattccatttattaggatacgttataacaatatac

SEQ ID NO: 8688 - DNA, 258 bp, Diabrotica virgifera
  Clone ID: pGUT2773
aatgaaagcttgaatgaagggttggaagaaaaaaaaactggctttaattaatttattaagaattttatttttaaggtaaaaagcctaaatttttttaaaagaagaaaagaaccttttaaagtttattaaattattaataaggttttttaagaataaatttaattatattataaaattaattaattggggtgaataaaaaataaaattaaccttttttaaaataataatataaataaaaaatttttgaatccatttttt

SEQ ID NO: 8689 - DNA, 213 bp, Diabrotica virgifera
  unsure (1)..(213): unsure at all n locations
  Clone ID: pGUT2777
gagttctaattattttatccccccccccgtcggggtttttttttttttttttttttgtgtccccccccccgcgcgcggtctttttttttttttttctctctctctccgggagagaaaaaaattgtgtctctctctctctcccaaaaagaagaagaaccaatataattatattaaactttcngtttggtggggggggggggcgccccccccccc

SEQ ID NO: 8690 - DNA, 382 bp, Diabrotica virgifera
  Clone ID: pGUT2778
caacccattcttcggggttggaggttttaataatatttgaaccgcagtggtgggtaaaacaattattaaccaaaaccgtctattattattttttgataccttaatagtttatcaaaaaggtttcgtttatcaaaaaactttaatttaaaccagtacctttttgaataattaaccaaaccggtttttttttaatttctctaaaaacaattagaatcggctataaattaatataattatggtggctattcttcggcaaatgcttaattattgagtttcaaaagcaaagaacgggaaaactatgcctttttgaaaataactttttcaaactaatttaaaatatttaaaaatatgtatttcaagaaataaaaaaaatcctcagctt

SEQ ID NO: 8691 - DNA, 482 bp, Diabrotica virgifera
  unsure (1)..(482): unsure at all n locations
  Clone ID: pGUT2779
ataaaaggcagaataaggttggataataagttaagtccggttaataattgctggataaaccggtattttggtcacaatccaaatactttttggaccagaaaatttggtaaccattcaagtctaatcatttccttactatattgggaattctaagggattaatggtagaatatctttatttaaaaaattcacttgtggtttttggtaataagtaatattatttattttggaaaaagtatggtataaaaatttgaaggggtatttttgtgacggctttgtttcttataccccactattttatcacgaatgaagctgtacataaaggaatttgtatgaatacatcggcattgtcgaatttggtttttgatttttggcacacaaattttgtaaaaaaaccccaagtatgaataaaaatatannccttttnnaaannnnnnnnnnnnnnnaannaaaaaaanaaaaaaaaatttcctgggggggggg

SEQ ID NO: 8692 - DNA, 465 bp, Diabrotica virgifera
  Clone ID: pGUT2780
ttcttcactatttaccgggtattgggtacgtcgcatggtagtaggtaacgggttgacttcttctttggtcgtcctgaaaaggccaactcttcacccttggatcttggaaactccattttggacaatccatattggccccacttttcttaataccgtcatcccccatatgaattcgtcggagaatctcgcaaataatactttatggtcaactgggggctggcccatggatactgacatattagcctcgccatatgtattaattagctcaccagtcgcttgtctaaactttactattgcaaggtgataattattatggtctcgtactacatctggacgtgcgatagttctcgttgcacctgtatccaccaaaaatgatctacatctattactgatacgaccttcgatgtataagttgtgaatccacccgaggacgtaagggtgacagttactatgggggctctaggt

SEQ ID NO: 8693 - DNA, 195 bp, Diabrotica virgifera
  Clone ID: pGUT2782
caagaaaaaaaagggtggatagaatggaaccaaaaaccaagagcaatggcttttaaattaaaggattaatggaaaaaggatgccacctattggaagaagaaggactgcttcggttgtccctttctttcaattcaaaaaaataaaggtcttttgaatccgaaaataatgaatgttctaaaaccacaagtcttaggg

SEQ ID NO: 8694 - DNA, 308 bp, Diabrotica virgifera
  unsure (1)..(308): unsure at all n locations
  Clone ID: pGUT2789
ctcgtgcccgaattcggcccaaaattaataccaaaagaactggttttaataaaccaggggaaaaaatggtggccaatttctttattaaacctatttattttactaatttccattttttaattactatattaatcatcttactaatttaaataatttaaatttaatattttaataaaaaatttattaaaaattaaaattattatttttaaaattaaaaaaaaaaaaaaaaaaaaaaaaaaaaaaaaanttttggggggggggccccgcccccaattcccctttaagggggggttttaaaactccccggg

SEQ ID NO: 8695 - DNA, 157 bp, Diabrotica virgifera
  Clone ID: pGUT2791
attccttattaaaattattaagggaatattggacctaattaccccaaatggtaaaatttttaataaggggtggtaattaataacctccaataaaaaatggggttggaaaatggcggttttattgaatcctaagaactttattaaattatctaatctt

SEQ ID NO: 8696 - DNA, 108 bp, Diabrotica virgifera
  Clone ID: pGUT2794
aattaactcttttaaatatagggtccttaaaccgccaaatccttagaatggattttggatcctgtggttcttaaattaattgtaaaggtggaccattatttaaatttt

SEQ ID NO: 8697 - DNA, 390 bp, Diabrotica virgifera
  Clone ID: pGUT2798
ctcgtgcccgaatcggcccaaggttttttttttttttttttatttaaccccttttattacctaagtcccaacgaaaaaggggtttaagcgggggcaaaaaagcggcaaaaaaaaaataacctttcttttttaaaaaaaagtcccctcttttttggccctaatttaagccaaatcctttaaaagggcaaggggggaaaaatggttgggaaaaaattttataaatttaaccggccccggaaaattttcattggggggggtgggcccttaacacgggggacggggtcccccttttcggagggggcccttttttccccaactttgggcccaaataaagccttgggggggggcgaaaatggttccctccggccccccaacggggattttttcccg

SEQ ID NO: 8698 - DNA, 547 bp, Diabrotica virgifera
  unsure (1)..(547): unsure at all n locations
  Clone ID: pGUT2799
caccgaggaaaaagaacctttacttggccacatggggaataaggatggtatattaaccgaatacccgcctggggtcttgatcaaaatccattcttattaaacttcggtactttcataatttaacatttggctaaaaatgaccaaccccaatgcaacgaaagaaaaaaattataacttgcccaaaatttggtggccaacagcctttcctggaacaaaagtaatgattggtatcatggggaatcggggaactgaacttttattatcgtacgaagaatagggcatcaaaggcttaatcccgaattaccttgggtacccaatataaaaattaatggcggtctatgatgcagatataaaagatcaagcttttacagatcttacatctggggtttgcaatttactaaaagaatataaaccagacgtttgtaaagatcatgtgacanatgttcatccaaagatgatttaaaatattaaaaaatgttgaatgaaataagttgtttcgttaaatacatngtttccgtatatataaatanataatacttgtgaaacg

SEQ ID NO: 8699 - DNA, 168 bp, Diabrotica virgifera
  unsure (1)..(168): unsure at all n locations
  Clone ID: pGUT280
gtaaagcccttcatacagcaggcaaaaagtgcatccacgatcaagtacccgccttctatgctaacactggaaaacttttgggtgaaattgctacatgtgctgctgcctaaattattaaaagatgttatgaccttttgcaaaaaaataaaaaaaatttaccatannnna

SEQ ID NO: 8700 - DNA, 331 bp, Diabrotica virgifera
  Clone ID: pGUT2802
gtttgaacccttccacttttggaacctccaaaaaatttcgtggcccctttggcctaaaagggatccggccttaaagccgtcaagccttattccaacggtgggtaccttccacccttacccggttcaagtattaatgggggtacttaccccaccctcaactttctttaattttataaaggtaaaatattaaatggcttataaaaaaataccggctggaaataaaaaatggaaatttaagaatggatggatcttttggctctccttctcataaaaatataaaaaacgggtttttccaaaattaaaaaaatatatcaggggggccacacccctt

SEQ ID NO: 8701 - DNA, 113 bp, Diabrotica virgifera
  Clone ID: pGUT2804
caaaactttactataattttgagcccaccctatcttatctatttccccccccaattttctcctataacaaaaaaaagggggccccctgtggagggacccccctttctcccccc

SEQ ID NO: 8702 - DNA, 104 bp, Diabrotica virgifera
  Clone ID: pGUT2810
accaaccaaacttttacctgcttacttagcctatttcgaccttccaaagggccggccgtggaagttcctggttttgcttgcccccggttttactggccgggggg

SEQ ID NO: 8703 - DNA, 324 bp, Diabrotica virgifera
  Clone ID: pGUT2816
cttggaggattccgccccaacctcagccaggattttggcaaagaaaagtattcctttgccggcccagttttaaaggattcccccaatttcttaattaccagaagctttccagtcttttaaaacttgtaccccaaaggtattaaacctttttaaaaaaagggcatggaggtattaatttaaaaaaattaaagaaagaagggtttaatcctccttccagaaaaaaacccaatggatatggtcatttggaaatgggcctaaaattctaatccaaggtaccttgcctggctttaacttttgaagaaccaaagaaaagaatttttggaa

SEQ ID NO: 8704 - DNA, 351 bp, Diabrotica virgifera
  Clone ID: pGUT2820
tttttgtaaccaaatcgtaatccctcctaaaattacctaattttttaccaaataaaccaattctctctattaacaatttttttactattaaatattcttattttactaaaattaaaattttttagggatgaacttaaaaataaaattttattaaaatttaatttttaaataaaaattaggattaaaaattttcatattttaaaaaaagcaactaataaattctaaaaattaatattttcaatttttaaaaactttttatttaaatttaaatttaaattatttaaaattcagcattgatgaataatttaattattaaaaaattggtttatttagaaaaaatatatagggtta

SEQ ID NO: 8705 - DNA, 157 bp, Diabrotica virgifera
  Clone ID: pGUT2824
ctcgtgcccatttcgcacgaaccacaacttaactttccaaaggtggccaaattctaccaaaaatggccccagccttaaccttcagaaggtatgtgatcgttggacttctggtaaaaaaaacatttaaaaaaatggtaaatactggacctactatatt

SEQ ID NO: 8706 - DNA, 190 bp, Diabrotica virgifera
  Clone ID: pGUT2826
ctcgtgcccgctcgtgcccaaatccggaccaaggccgaacctcccgttgcagaaagggctccaacttcggataatcttcttctaaccacaagaaaaaaggctgtactaaccccccttggtcaaataactcgctttcccaatgcgcccaaaatccgttggacggcaaaaaaaaaaaaaaaaaaaacccggg

SEQ ID NO: 8707 - DNA, 303 bp, Diabrotica virgifera
  unsure (1)..(303): unsure at all n locations
  Clone ID: pGUT2829
attttaaaaatataaaaaacaaatttttcagaagggtgtgtctttagttacgctacgagtgactaaaatcaagaatataaaaaaatcaaccaaaaagcaaaaaacacaaaaaattccaatttgaaggactattcgaaaaaaactgttagacagactaaatatacaaaaaaaaagaacaaagagctgggataaaaacaaaatcacacagggggggggcccccccacccataccccctttatgggagagtaatacaactccccgcccggggttaaaaaaagggnggacatttggttgactcactt

SEQ ID NO: 8708 - DNA, 306 bp, Diabrotica virgifera
  unsure (1)..(306): unsure at all n locations
  Clone ID: pGUT2837
aaaccattaccaatttatggtttaaaaaaaaaaagggggggggccgggaccccttggggggggggggggggcccaatttcccctttgggggggggttttaaaaatcccggggccgggttttaaaaannntngnnnatanatctttggacgattttcgtgggttgtgcaccggaaacaaatatccaattttgagagcaacttaaattagggtggaatacttttgttaggatgagttacacattactgacgagattgttgattaaatatttgcgatcttgtcgatattttctattaaaataaattaat

SEQ ID NO: 8709 - DNA, 184 bp, Diabrotica virgifera
  Clone ID: pGUT285
gttaaccccttcatacagcatgccaaaaatgcatccacgatctagtaccactcatctatgcggccacctgatgaccctcgggtaagctgggtgacactagcagtgtgcagcgtcattatatcaactactgtccgtctgcaatgaaatctcatatattttcacgtcttcgtgcgacttggttgtg

SEQ ID NO: 8710 - DNA, 474 bp, Diabrotica virgifera
  unsure (1)..(474): unsure at all n locations
  Clone ID: pGUT2850
ccccaacctacccttcagaacccaggcttcttaacttttaccaaggcttgccccaaattggcaaatccacccgaattcaaggcagcttccttagaaaacctaagaaaagtcattgatccaccaaaaaaattggaacctaatcctttccgtgacccaaaaaccggccaaaaaggattctggtaatccttgaaaaaccccaccccacttggccaattcgtaactccgtcaaacccaaaggaatggaagaagtttccttgtagaattaattttggaccaattccctgggttgtcccccgaaaccaattccattttgaaaccgctaatttaggtgtatagtttgttagataattacacatactgacaaaatgtgataaaatattgggatcttgtgatatttctattaaataaatagtgtctatacaaaaaaaaaaaaaaccccnnnaaaaaaaaaaaaaaaaaaacccctgggggggg

SEQ ID NO: 8711 - DNA, 224 bp, Diabrotica virgifera
  Clone ID: pGUT2852
ccaacctctggccgattccggaccaaggagaacccaaaccggttggccggaaccaccttacccttcaccttcaataaaaccaaagccgcctcttgccttccaggaaccaccggtaaggggcctttaccaaaaaccaccggaaaatggcaggtggtggtgattattggggaattagtgggaaaaaaggccaccggaattataaatttgggggccattggggccaa

SEQ ID NO: 8712 - DNA, 577 bp, Diabrotica virgifera
  unsure (1)..(577): unsure at all n locations
  Clone ID: pGUT2855
tgaaaatgaacaaaaaactgaaagtacccaaaagggacttggaaaccgntcgtgaaaaccggccatttctggattctcccgaagaaaaacccctctcagactggaaaatggtaaaaaatcaatcgccccaattatctacccacaactagaaccccatggaaccttattcgtagacgacagaacctgcatgactantttattaagcggtatctggagactagaanagtgtggaaaggtcagacccttcatctgcgagaaccaaaanagtgcggttcccggtggaactatcccagctgatgacgtcgttggtacagttggtaaagttaaggatgagacagaggtcacgccgcctgcagcacctgtttataaaaagaactgtttgggtaaaccgattgttaatgtgtacgttaacaacaacttggtgtcttctggtgttagtgtagcacctggagtagacgaaggtcacaagaatcaaggcacttattccgttaatattaacaacagcttaaaaccatgtgccaataaataaaaaattaatagcaagctttataaataaatnttaccaaaaaattacttg

SEQ ID NO: 8713 - DNA, 466 bp, Diabrotica virgifera
  unsure (1)..(466): unsure at all n locations
  Clone ID: pGUT2856
attcggcacgaaaatttaatattttggaaaatattccatacctaatatcctaccttaattttggcctataatatggtattcaaggtatttcccattaaaaaaccaaaaaattattaaaaagtatatgtaggtatttaaggtaaaaaaaattggtttcactggatttttcagtgatttaatacgaaatctttacccatctcatattatnggatttttgggcatatataattaagtatattaacgtatttaaaggtttatatttctcatataacgcaataggacacaatgttataaataaacatcttgaaattacaaattataatacataataaataaatcaggtcaattantnnnnnnnaaannnannnannaannannnnnnnnnnnnnnnnnnnnnananaaaaaaaanaaaaaaaaaaaaaaaaannanaaaaaaaaaaagggggggggggggccccccccccc

SEQ ID NO: 8714 - DNA, 149 bp, Diabrotica virgifera
  Clone ID: pGUT2859
catctaccgaatactaacaggacgacactcgaggaataatcgggccattacttcaagagcgttgttttttacataatgaccttgaggactttttcatagatccttaaacacacacctctttttctgactaacacttcgacctcctaaaa

SEQ ID NO: 8715 - DNA, 386 bp, Diabrotica virgifera
  Clone ID: pGUT2864
gaagggtcaagggtttattggtttgactacctatttggaccggtgggtggaaggtaaccataaccccatggattcctttggcaaaaagcgccaaatattccaactaatcaataaactataaaattttttttacttccattagaccaccaaaaccaccaaaaaagaactcttgtttttcattatccaagtttaacaccctaaaatgccatttaataacaaatggagctaagaattgttaccactactgcatccgaaagcatactatctatatgttatagtcaaagcccgaatttcaggcactcctaggtttgactaggcaatcctcaggtctgactgacggtcttaagccacccgcacacacagctactaaaaaaaaactcgagggg

SEQ ID NO: 8716 - DNA, 676 bp, Diabrotica virgifera
  unsure (1)..(676): unsure at all n locations
  Clone ID: pGUT2866
ctcctggccaattccggacgaagcaccaaatttttcttggcggagggatccacttggagaaaccatttaaaagaagtttcggaaaaaaatttcaaaaatttaaaaaatgggaccttgaggcctaactggaggtaccttctttcaaaaaccaaaattcagtggtaaagaatttgataaccaccagattcgacctagttaaaaaaaaggtggagggtataattaacgacattaggcacagcaaaattaagataggtaactatatgaatattcatcgagaaacggcaaaactcttcgaagaaatttaccaatttggcgaagctcgcataatgtatgatgctgatagaattcgtattgatcaggtcanagagggagtctataacgacgtccacgatgaacaagtaanatctgaaaaagtagaanatccatttgaaaatgtagcttcaatggtaaaacattataaatccagatcttttanagcaagacttgtatgngagaaatgtccaagacctgggggtgtaggcatacctncttgngataataacaaaatctacgttgcagctactgacacccacaatatcctaattctagatcgctccaaaattaaactccttggacgaatcaacaatccagaaatgttatgtccaatgaatctagcgttttcgagaaagtttgacga

SEQ ID NO: 8717 - DNA, 241 bp, Diabrotica virgifera
  unsure (1)..(241): unsure at all n locations
  Clone ID: pGUT2867
gaanaatcagaatgaagctgttcatccttgccgctgcccttattgtggccacaagtgccaatctaggtgccttcgaaaaatggaccagttttaaggcaacccataacaaatcttacaacgttattgaagacaaacttcgtttcgctgttttccaagacaaccacanaaaaaaataatattagggggaaaaaaaaaataccccgggggggggggcccgcccccaattccccctaaagggggg

SEQ ID NO: 8718 - DNA, 133 bp, Diabrotica virgifera
  Clone ID: pGUT2868
gtcctctcgtcttttaaaaaaatttaagccttttaacctaagaaataaattccttattaattaaattaagaccggttttttttcattccacccttcatttcaactttcaaaaaaaaaacctcgaggggggccc

SEQ ID NO: 8719 - DNA, 320 bp, Diabrotica virgifera
  Clone ID: pGUT2874
caccaacctctgcccaaatccgcaccaagtttcttaatattaacctccgacctttcctggttttaagaattaaaaccaaggctttaaatggccatattggtaaaaagccaatatttgccgattcttaatgaaaacctaacccaaccggaaaaaggaaatcccgaaaaccccttattttaaccgacttgaatggagccagaaaaccggattaagcctcagataaagcttggggtccagggttggaccccggtattggaaggtactctgggtatttgactggtgataaaaaaccagaatctaaattggtcctctgggtcttt

SEQ ID NO: 8720 - DNA, 372 bp, Diabrotica virgifera
  Clone ID: pGUT2875
cattgggacccctaatgtattcccaatggtaacccactttggttaactggattcaatggaaaccttttcccaataaattggataatttttttaaaaatatatataaaattattttttttttaaatttggaaaacttatatcaaagaacaaaacttacttatttttgacatgataaaccaaacaaactccaactaattaaagaaaaagttgaaagaattatttaccgtgggtggggggggcgcacacaacatatgttattttggtgagtgttattcgagactccgcgccacttttaaaaaaaatttacccatttggcgaagcttgcataatgtattatgctgatacaattccgattgatcctgtcaaagaagg

SEQ ID NO: 8721 - DNA, 533 bp, Diabrotica virgifera
  Clone ID: pGUT2880
cgagttttttttttttttgaaacccggaatgaagggtgggaaaaaaaaaaaccgggttttttttattttaaaaaaatttttttttttaagttaaaagccttaattttttttaaaaaccaaaaaccccctttagggttttaaaaaattttaaaaaagtttttttagtttaaaatttttttttttaaaaaatttttttaatgggggggataaaaaaaaaaattaacctttttttttttttttttttaaataaaaaatttttggccccaattttttggattttaaaaaaaaatccccttggggaaacccgcgtatttttttggggaggtccaatccgataataaaattggcccccccggggggggttaaaggtttaaatgggggggccccccttttttttaaagcccggtccgcttttaaaaatttcccggggccggggttaaaccgggggggccccgggtggggtccaatcttaatttaataaaaatttttaggcccgaggggcccaattttttaaaatatttttttttttgagt

SEQ ID NO: 8722 - DNA, 295 bp, Diabrotica virgifera
  Clone ID: pGUT2883
acttcgggatattaccaaaagaggtcatacccccaataccactggcattttggggaggggtatcattatcaagtcacttgggaacactggcccgattcaacgccattcgaatttaatatttataccgtggaggagggatggatgaagtggtatgccttatggaagacttgattaccttggattaagactggaagtattaattggttgggttttaagggtgataaatttcgaatttttttaaaccaataattattggtatatggtaaaaaaaaaaaaaaaaacctgggggggggcc

SEQ ID NO: 8723 - DNA, 282 bp, Diabrotica virgifera
  unsure (1)..(282): unsure at all n locations
  Clone ID: pGUT2886
atggtggtggacctggtcaagtctaattttaaaccaaataataagggtaccgttaataaggtttaatttaaaataaaaaagtaattcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaannnnnngggggggggggggggggccccccccccccccccggggggggggggggcaccccccccccggcggcgccg

SEQ ID NO: 8724 - DNA, 287 bp, Diabrotica virgifera
  unsure (1)..(287): unsure at all n locations
  Clone ID: pGUT2887
ccncttcttctcttctcttctctctcttctctctctctctctctctctctctcgaccaaacttggtctcgatgagattctcactatggagacggccctatagtatcccacatctagaacgactggactaaggctaagaccacaattttattgatgaaaattccacctccataaagctgccatgtatctgcatctacagctatggatactggacctacgctagaaagagcactagccagtgcagcttcagttttggcaagatttacatatccactgatagtagcggca

SEQ ID NO: 8725 - DNA, 307 bp, Diabrotica virgifera
  unsure (1)..(307): unsure at all n locations
  Clone ID: pGUT2890
caccaacctctggccgaatccggcccaaggacctagcctcggagtgttttttttttttttgttgtgttcctatctttttttttttccccccacacaaaaaattttttttccccctttttttttggggggccaaaaatattcccccacacaaatttgggggggggcnnggcccccggggggggggggggcccccccataccccttgggggggggggtattaaaaacccgggggggggctttaaaaaantgnnnngtccatcgcactccgatttttttatttatacagtgatgaaggattgtattagtt

SEQ ID NO: 8726 - DNA, 217 bp, Diabrotica virgifera
  Clone ID: pGUT2894
cttgagaatttcgccccaagaagaaatgggttcttgcttgactgcccggccctggtggagggttgaaaaggtccagggaggaaaacttctggttatttccttcacttccggaaccaaaaaactttttccacccacccgcttaccaagttaaccggccgctaacttagggaaaaaaccttcggaaccaaaatacgtccttcctttattggtccggccc

SEQ ID NO: 8727 - DNA, 587 bp, Diabrotica virgifera
  unsure (1)..(587): unsure at all n locations
  Clone ID: pGUT2896
gctggactccaccgggggcggccgctctataactagggggcccccgcgctgtgcgagatctgcacgagcgctactacgactgctcaagttctactttattcaatagcgggcagcgccgctctaccagccctatctgaaataacccgctctggtcctaagaaaatgggactgtaactttcaccgactcttagaggaataccaaactccgtattcctcaagagtgttgccgatccccgtcaagtcgaagttgttctcagaagtccaaacacaagaaacccagatgttccaagttgtgggacccacttacaactggagaagctatcgaccgtaccctcgttggtgtttcacggtaccaaaacaacaacccaggtgatattcttactgatattttccggcagtatgaaagtactcttgaccacaccaaatactacagccttcttaacagaatccaaatgttagttgaagctggactcattaatgtaaccatatacgatatcatcagagactgggatcttanacaccgtggacaaggaattagtgacattgtccccacccaaggagtaagtactcttcgtcaatacgctgga

SEQ ID NO: 8728 - DNA, 281 bp, Diabrotica virgifera
  unsure (1)..(281): unsure at all n locations
  Clone ID: pGUT2898
agaccgcataagttgtgaccgccactatttctaatgtaaccaatttcaccccaactggttcccaatgagttttaaagaatgaaaacgtctttagtgtatccaacagcaagaactccggaattaaggctagttccacaattttattgttgaaaattccacctccataaagctgccatgtatctgcatctacagctatggatactggacctacgctaganagagcactagccagtgcagcttcagttntggcaagatttacatatccactgatagtagcggca

SEQ ID NO: 8729 - DNA, 638 bp, Diabrotica virgifera
  unsure (1)..(638): unsure at all n locations
  Clone ID: pGUT2899
cgagacaagcaacttcacatgatgaccgtgcgcattctgcgaggcggtaccanaggcggtccaatgaaggtaggtccacgtggccgaagcggctactgaaaccaaggaaactggaaccaagcctatggtggctacggatatggccaaggatacggctatgatggctacagccaaggttatgactactacggcagtggctatgggggttatggaggctatgattactcaaactatggcggcggtaactacggtaaatacacccacaggacacattaataaactttttactcccaaccgagatgttgttaatatctcgagtggtgccttgtaagctcggtgtatatgtcaagtgataactgtgtcagggttggctgtaggaaacttgttaccaactatacaaaaacgttatttttggccaaatacattttataaattgtaaacctggttgttctacaataccttgttaaattttaattntcgacggcataactgttggtatttttcaggttcctacagctaacccattcttagttctacacacaggaaggtcatatataacaagtgtgatattcacactanagactatgtggtcttgaaatattttttttataatttatagacatatttacactaagtcg

SEQ ID NO: 8730 - DNA, 297 bp, Diabrotica virgifera
  Clone ID: pGUT2901
aggaaaccttagggggaaaaaaacccaggggtggacttgcccttttctccactttcaaataaaaaaacctacggtaaagggttaattcaaaaataaaaatggggaaaatggtggataataaccccaatgcgggcctcaacaaaacggttttttagaattaccttactttcccctttccaaaggggaaagccccggctccccttttttgggttggcggatcaggaaaaaatgtcaaaggccaaactgggactttaaattttggtcccacctccccaaaaaaattccccggggggaact

SEQ ID NO: 8731 - DNA, 297 bp, Diabrotica virgifera
  Clone ID: pGUT2902
aatattcgaggttggatcctttggattttgatggagaaatggtaccttttggaaaccgagttttgaaataagtcttccctattggaccctccaaataatcgaccccttcgaaggtaaaaaaatggtcaacccttatattaaactaacatttaaaaatttttggtagtttttcttggtataggtttataaaaaaccgggagtaaaaaaaatatgcgtcggattgaaaaggttttgggaaatttcactttgtaccagtaatattgcaagcttttcttgtagcattgaacaatgaattac

SEQ ID NO: 8732 - DNA, 515 bp, Diabrotica virgifera
  unsure (1)..(515): unsure at all n locations
  Clone ID: pGUT2914
cctctggccgaattatttattatattgggccctttcgtcctaaaattttttattaatttaagaatgaaacccaccctgcttaaacgggttaaaactcaaatcttgaaaaatttaaaaggccaacaaactttattattatagctggtcccccaatattaaacttaatccacatcgaggcgcatcttatatcgatttgactctcaaataaaataccgctggttatcctaaaggaaattattcttaatatcaaaaaaatgggatcaaaaaaatattaatttatataataatataaaaaaattaaatttattttttaatcaccccaattaaaataatttattatataaataatttattactaaaaaacttattaatatttataaactctatagggcttctcgtctttaaaaaatttaagcttttaacttaaaataaattttttataattaaataagaccgttttttttcattcacccntcaattcaactttaaaaaaaaaaaaaaaaaaacctgggggg

SEQ ID NO: 8733 - DNA, 588 bp, Diabrotica virgifera
  unsure (1)..(588): unsure at all n locations
  Clone ID: pGUT2915
aaaaaacccaaggttaagaattggcttcaaaaccaaggttaaaagaaaggtttcttggtttaattaccagaactttgtattaattaaattaataaagtttaaaaaaaaaaaaagataaaaaaaaataaaaaaaaaaataaaaaaaaaaaaaaaaaatttcctcggggggggggggcgccccccccctcccttttaaggggggggtataaactccccccgcgccgttttaaaaaaaaatnnnggttnacacccagacgaggattggagaaattaataaagctattatcaaccaaaaagaacccgtcattcaagaaatcttaaagttggtttatgacatcaaaccataaatccacatgaactacccgctatagttggcaggtgcaatattgtagttaataaggactaaaatcacttaactggttattgaaggttcattccattttattggacttcccttctttttggacgcgtttagactatttacaacaaacctttgaagttctacatgaagatccttttttaaggttaaatgttctaggtgattatttaaagttttggtgtttaaaaaaaaaaaaaaaaacttggggg

SEQ ID NO: 8734 - DNA, 182 bp, Diabrotica virgifera
  Clone ID: pGUT2916
agaaccaacaatcggtcttggaatagaaacggccccagggccgaatggccatcaaacacagaacgtgcttggctacgggccgaacgctaactgaaataccggccctgcgccattagtatcccgtcgagcgagtctgtcggaacatcaagggtccgcataattaaaaattacgcgggctccac

SEQ ID NO: 8735 - DNA, 78 bp, Diabrotica virgifera
  Clone ID: pGUT2921
ctgcctggtgcccgaattcgcaccaacttcttgccaaattcggaccaaggtggccaaattcggaccaaggggggggcc

SEQ ID NO: 8736 - DNA, 354 bp, Diabrotica virgifera
  unsure (1)..(354): unsure at all n locations
  Clone ID: pGUT2922
ctctgttttgtgccgcatgtattatgttcgcagcttctggtttttgaaaccattctctcaggttctcagccagggatttctttcttcctggccccaaacctctttctacctttcaatccttgcctttcgacgataagctgtagcagactgtacttatcattacggaacacatggcccangtatgacgctnntcctccttttacagttggtaacaattccaactctttacccattcgtctcaataccctctgtgttggtcactctgtctgtccaaggaattctcaatatgcgtcgatacagccacatttctagagccgctaactctttatagttgctgctgttaacgtccaccct

SEQ ID NO: 8737 - DNA, 328 bp, Diabrotica virgifera
  unsure (1)..(328): unsure at all n locations
  Clone ID: pGUT293
attacccttattatgcagcttctccgagataacctcacactttggacgagtgacacgcagggcgaagctgatgagcctcaagatgctggtgataattaaaagtgtggagcgtcattttttacacaattattcgttaataatgaaatttcatgtaagttgacgtattcgtggaacttggttgtgaagtttcattgacagtctttagtttcatcctgctgaaacttcgatatntaaaatgtttggggagatatgtaaatcgttaaatctatatttcacattatcacacaaccgtcatacttttcgcaacaagtaatttaagcccataaaa

SEQ ID NO: 8738 - DNA, 241 bp, Diabrotica virgifera
  unsure (1)..(241): unsure at all n locations
  Clone ID: pGUT2941
aaaatttttatgaattttatgaaacaaaacgtatcacatatacttcagagntgtgaatatctattgtacaataaaatgaatccataaacaaatacctgtgatagggtattataaaaaagttcgtaaaaatttctatgtaccactacacatgacgagatttatctatcaataactcacaaatataaaaataatttatatatggatattctaaacaatgtgcatcccttttagataactagac

SEQ ID NO: 8739 - DNA, 463 bp, Diabrotica virgifera
  Clone ID: pGUT2949
taaaattattattttttaaaagtaattattaccttttgttaaatatgaaaaattttaaatctaaattttatttaaaaattaaattttaataaaaatttatttttaagcctcatcctaaaaatatttaatatttattatattaaaatatttaattattaatatatttgttaataaataaattaatttaatttcttaaaaattaggatatatttaaaaccgaatacatttcattaaaaaaaattatttaaatatttatttacaataaaaatttaatttttagctcttttaaatcgaaataataatatataattataattaataatccctgatacacaaggtacaaaaaataaatttttcttttattaaaataaaaatattctctcacaatactaattaactatcattaaataaaaatttttctttacttttactaaaaaatattttattattgttaaaataaatt

SEQ ID NO: 8740 - DNA, 319 bp, Diabrotica virgifera
  Clone ID: pGUT2952
aaaaatggcattttttcagtttttttttccaatcaatgggaaacaggggaacgtatggtttttttagtgcaagtatcttctagattatggaaaaagcttttaaatgacgtatttcaaaatttgatatacagtagaactccaattattcggactccaattattcggatcgcaattatccggatcagattgagaaaaagaaaaaatcaagtttgtaaaaaaataattcattttactgtgagttaagattgtgtgtccatattacgtaatgtaaactttgtcatttacatattggtgggtatactgcattatttttcataat

SEQ ID NO: 8741 - DNA, 149 bp, Diabrotica virgifera
  unsure (1)..(149): unsure at all n locations
  Clone ID: pGUT2957
tggggtctatcttttatttattaatatattttagtgcgaaaggaccacatatataaaataatttttatatttagataaggtgttctnccaaaaaaaaaaaccggggggtggacaaaaaaaaaaaaaaaaaaaaaaaaattggggggggg

SEQ ID NO: 8742 - DNA, 297 bp, Diabrotica virgifera
  unsure (1)..(297): unsure at all n locations
  Clone ID: pGUT296
actcaccgcgggggcggccgccctaaaacaattgattccccggggtgcaaggtcctgacaaattccggaccaaggcctttaaaccatgggtcctggaaaaattgggacacctcattaatggcaatacctgctcacaaaaatgtgaaagcatgggctcatattatgtgggaggcatttgttaccaaaacgactgttattgcgcacacctcatttatatatgtagacatcgcaccagcatcttaataatatatagtttcacaacatgtaaaaccccgaaaaaaccaccaattnatttct

SEQ ID NO: 8743 - DNA, 191 bp, Diabrotica virgifera
  Clone ID: pGUT2966
tacattggtatggtagtactgcgtctaccctgatttttaggattttataaaatttattaactttttaaaacaaatattttaatgttataataactagaatttttacgctgaccgctgattatttgtgttttttattttgttttgatatttgtgctaaaatatctgcattataattatcttcagtttgatcc

SEQ ID NO: 8744 - DNA, 221 bp, Diabrotica virgifera
  unsure (1)..(221): unsure at all n locations
  Clone ID: pGUT297
gtctttaaagcagtggctcttggaaaagttggagcatcatgtgattgcgatacctgctcacaagaatgtgaaagcattggctcagattatgttggaggcatttgttaccaaaacgactgttattgtgcatacattaattaaatatgtagaaattgcaccagcatnttaataatatatagtattttaacatgttttgcccccaccaacaatgaaattcccaa

SEQ ID NO: 8745 - DNA, 389 bp, Diabrotica virgifera
  Clone ID: pGUT2971
aatatctagttgttttataaaaaaaattaataatataaaaatatataactacctaaaaactacataatttcatcagtatattttttataatattaattgtgtaacaattatattctgatagaattactaattttatattaagttacaacccttttgatgtaattcttgaatttctcatgctgcttgtcttgcagcttcgcgatcttattcttggctttttcgtctttacatctagcacatacctcttttgtaaggccatgtaatgggctctggtaataaaaggacagatcttctagttctttgttctttctgtgaatgcgagtatgtaaaaatatttctatcacgcaaacaaaaacgagcatgatgggatggaagaatatcattgtcgg

SEQ ID NO: 8746 - DNA, 280 bp, Diabrotica virgifera
  unsure (1)..(280): unsure at all n locations
  Clone ID: pGUT2974
cacttgcttatacatttggcgcactgtctgtcaacgtgttaagcaactggtacgcgaaggaaaagatagaagcttaaaacaagaaaaattgaatcttgactatctaacatctcacctgataaaacaatgtacagtgaacgcctacgcagaaatgcacagcacgttaagaagaagagtctgtgagagttgatgaagagttgatgaaaggatgatacgtgattntttcaagcatctttttttgcctttcttcatttcttggattttctgcatctcttgatta

SEQ ID NO: 8747 - DNA, 291 bp, Diabrotica virgifera
  Clone ID: pGUT2983
tttaaaccacgtgacattcgccggagattagcataaatatgctgaaatttatccacacttattctcttaaaagcataaaatctgtctgagtggtgtttcttaagctctttgaataggtgatggcattcttccagatactgcctttttgatttaaaggatgagccgaaaactggcgatttgaagaattacaaatgatccaccacttttcacttcaagacatgtaattactgtcgtcaatactggtgctcatgtacataagtgtgaacagccgtagcgcagcggcatgatact

SEQ ID NO: 8748 - DNA, 166 bp, Diabrotica virgifera
  Clone ID: pGUT2986
acacaacaagaacgtttgtggcaaactcaaaacctttaccaaactctaccacgcgtgtattaaaaactgctttatttgtaatttgttgttaaaatgtttgttataattgttgaaaataaataaacatttgtttttgcaaaaaaaaaaaaaaaaaacttgggggggg

SEQ ID NO: 8749 - DNA, 365 bp, Diabrotica virgifera
  unsure (1)..(365): unsure at all n locations
  Clone ID: pGUT2995
tatgataataataatatgtctatgagattgacgcgatcttttttctttttttctgcgataagtgtttgtcttcctattttgttaaaaaaaaaaaataaacgcttgaaatatcttggaactactaacaagtttcgacattaattaatttatatcgagaagatgtttatattacaatgtaaagcattcacagccttataaaaaatactttcaacctttgccttttcattgtgggtggganaaaaaaaaacacgccgacccgtcttctgncggggggtcgttgttctagggataaaataattatactatattttttnnntttggggggggggggggggcccgcccccccccccccccggggggggggg

SEQ ID NO: 8750 - DNA, 168 bp, Diabrotica virgifera
  Clone ID: pGUT3001
cgcaaccatgggagtaatggtagacacaattacacccggtgatggacgtaccttccctaaaactggtcagtttgtttcttgtcattacacttgtaccttggaggatggacaaaattcgatttctctcgagacagaggagctccttttaagttccacattggaagagga

SEQ ID NO: 8751 - DNA, 302 bp, Diabrotica virgifera
  unsure (1)..(302): unsure at all n locations
  Clone ID: pGUT3007
atatattcgacgtcctcttcataaagtgctcatacgatntgcattagctcgtcagtgttaaacaagttaccagataaaattctttggtggtttgcttcttccttggaatcacctgagttcttaaatccttgaataaaatttccagcggaaaagcagactacacagtttggatcatctaaatctggagctggaccctttatgttcattggaatngcaactgatactgcaagaccaatgcaagcaaagaatgtaataatgaaaatggatttcattttttgtcgagttttttttttttttttttt

SEQ ID NO: 8752 - DNA, 297 bp, Diabrotica virgifera
  Clone ID: pGUT3009
attacgagagtgaatggaacaatggtcaaaagattgtctcacaacaaacatctgatgattgggaacaacaaaaccaacaattcggtggaagtgacagctacgttaaaactacaaagactgttgttcattcttcgatacctgaccacagccacattcacaaacaaaccacacataactcccattcccactcctcgatagaagagactgacgtcaacttgattatcgaaagacaagaaggtgaaatcactcacttaagaacagtccttgccaacgctcatgttgctcttgatgctcatg

SEQ ID NO: 8753 - DNA, 354 bp, Diabrotica virgifera
  Clone ID: pGUT3019
ttcgcttttaaatatatctaattttttaagaaaaaaattaaatttatttattaacaatatatttataattaaatatttttatattattaatattaaatatttttagggatgagcttcaaaataaaattttattaaaatttaattttttaataaaaattaggattaaaaattttcatattttaaaatatgggattatttatttttatatattattatttctattttttataaaatttttatttaaatataaatttaaattatttaaatttagtaatgatgataatattagtattaaaaaattgtatatttagtaaaaatatataggtttaataaaagaattcggccacatttttt

SEQ ID NO: 8754 - DNA, 78 bp, Diabrotica virgifera
  Clone ID: pGUT3026
ttttttttttttttttttcccgggggttcccccacctttgtttaatccgattgggaaaaaaaaaaatttttggggggg

SEQ ID NO: 8755 - DNA, 236 bp, Diabrotica virgifera
  unsure (1)..(236): unsure at all n locations
  Clone ID: pGUT3029
ttttaggaacaaagtactatttatgttgacattatttgttagagattttaaagataatgaaaaagtggttccgctatttactgatattttaccacaattagcactactgaaaattgtttacaaacatatcagacaactttgaatattaataggcaatattatatttttctttagaggaacttagactgactntattcacatttataaattgtttataaataaaatttttttttttc

SEQ ID NO: 8756 - DNA, 353 bp, Diabrotica virgifera
  Clone ID: pGUT3036
gcaaactgtatcgagatagtgttaataggaaatttccagatagatcccttcacacttaccatgtttaaagcaacaaaggcactgctgaagcacggaacagatcataagtatttatccgaagactacaaattgattggccacaaccaagttaacacgactaaaagtccggggaaaaatgttctggctgtaatcaatcagtttcaacatttcgatcctaccgactacaagggtattccgctagactccgatccaatgatattgacttcgtctacaatacctacaacccttaccgaggacgaggagtagacgaaaagctaccaccaaaaaaaaaaaaaaaaaacctgggggggggg

SEQ ID NO: 8757 - DNA, 378 bp, Diabrotica virgifera
  Clone ID: pGUT3040
caacataataaacacggttataagcacggtcataaatgttgtatcaagcatacttattaaagctttttgtggtgctataacaccttatttacttctcgtatcagtctttagaagtacagttatcaaagctcttagtttaattgtgcaatttttaggtgaggtagccacatcactgttgccagctttgtctgatactgttacacaaattactagtttcatatctactgtagattccacaattggtaatgccttagattatgtaaacaaagcaggatgttctgtttcagtgtaaatgcacctttaatgtagttgtttatgtaaaatgtgaaatattaaaaattttatttgggaaaaaaaaaaaaaaaaaaacttgggggg

SEQ ID NO: 8758 - DNA, 354 bp, Diabrotica virgifera
  Clone ID: pGUT3046
gcaaactgtatcgagatagtgttaataggaaatttccagatagatcccttcacacttaccatgtttaaagcaacaaaggcactgctgaagcacggaacagatcataagtatttatccgaagactacaaattgattggccacaaccaagttaacacgactaaaagtccggggaaaaatgttctggctgtaatcaatcagtttcaacatttcgatcctaccgactacaagggtattccgctagactccgatccaatgatattgacttcgtctacaatacctacaacccttaccgaggacgaggagtagacgaaaagctaccaccaaaaaaaaaaaaaaaaaaactcgggggggggc

SEQ ID NO: 8759 - DNA, 286 bp, Diabrotica virgifera
  unsure (1)..(286): unsure at all n locations
  Clone ID: pGUT3053
atctaaaatgctcccatagtagctgggtgggaggcacattcagtagtatacaatgcaacggtatatatgggagtgggttacattccagctttgggaggcaacaatgtaggaaaagtatatcacgggctttcacaaacacaaaacagaaaggatggtagtttatacatagataggtcaggtgtgtctgcttgatattatctcgctggtggtagtttcaatgtgccagtttattataaataaatgcaatgtaaagcaattctgaattaaattactttatangtagtct

SEQ ID NO: 8760 - DNA, 166 bp, Diabrotica virgifera
  Clone ID: pGUT3054
gatacactaaagatgtcttcatcgttaaaactcatggggaacaggctggggtgaacaaggttacatcagagttgcccgtggtagcaacttatgtggtattaacctcatgaactcttaccccaagttgtagataacagttaatgaaaagtgatatatttataataat

SEQ ID NO: 8761 - DNA, 488 bp, Diabrotica virgifera
  Clone ID: pGUT3055
ccatataataatctgtattttttaacctatactgtaatgcgatattgagaacttattgttctcgtagaataaggatttagatttataaatgacaagactgcagataaatttatacataagtaattataatattcctcaaaactgaaaggaatcaattattttttattttttcatccaaattcaacataattttctttataggtacctatttcctttcttgttcaccaattaatgttgtggttgcataataattgctgttaaaaattacataacatcattgaatatcagtaaaaattacaataaattattgattacccgtaaaaattacataaaattgttgaatatcagtaactatctaattatctaacatttctttagtgatattgtaaaaggtgatcggaattgttgataacatctggttctttttatttgataaatcttttagtatctaacattatttcatgctttaaacaatctaactttgactg

SEQ ID NO: 8762 - DNA, 233 bp, Diabrotica virgifera
  Clone ID: pGUT3059
aaaaattattaatttatataatactataaaaaaaagggagattttatttttaatcaccccccctaaataaatttattatatttataaaatttaatactcagaaaacctatttataattttataaaactctattggggcttctcggctttaaaaaaaattaagcttttttacttataaataaagaatctttataaattaaataaagacaggggtttttttattcaaccccctca

SEQ ID NO: 8763 - DNA, 51 bp, Diabrotica virgifera
  Clone ID: pGUT3064
gactaatctaggattctttttcaaaaaaaaaaaaaaaaacttggggggggg

SEQ ID NO: 8764 - DNA, 387 bp, Diabrotica virgifera
  Clone ID: pGUT3065
aaaaatttagtcaagtttgatcggacatgcagtgaaagtccgtttttttttggtctgtgccaaagttaggctcaaatggaatcttgagtagattctgtagtgaaagtagcaagagcgatgtgtttgtcgtaaatactttaccggtatattcttgtgtatctaatagtggcgtagagtatgcctttttcaagaataacttaattcaagcttcgcaaggacgtggtccccgaccttttaactaaaaatcaattgtttaaacaaaattttgctattatcaagtgagcaatgtttaaattattaaattgtgcaaatgattcaataataagcaattaggtagttactttttttaaataaaaaaactatggaattttatttttcgtataaaaa

SEQ ID NO: 8765 - DNA, 221 bp, Diabrotica virgifera
  Clone ID: pGUT3067
caataaacatatctctctctctttgtcgttccccattactgaggatcgtgatttcttccaatattcctaacattttttatcctctggtctctatccttagctgctctaagagcttcgcagaatgagtttccagctgaattcttaatttggtcggatcatctatttggtgatcgtcctcttgaccttctctccggaacgtttccagagaaataattaatctc

SEQ ID NO: 8766 - DNA, 448 bp, Diabrotica virgifera
  unsure (1)..(448): unsure at all n locations
  Clone ID: pGUT3073
tttaagtctcgtagctactttagcattcgatagtgcgattgccaatgatgtagcaaaaccgtgtgagtctgattcttgtacgatcggcaacaattgtagatgttctagtcaagtgtcacctctaggtggagatctcacagagtatcctcagctgattagtttaacatttgatgaagctgttacacaacacatctacgacaacagttggattacattgctcggaaatatatataatccagatgataagccaattagtggaacattctttgtaccacatgagtatacgagctatcaaagagttaatgatttgtacaactttggatttgaaattggtgtgcactcaattacgaaggattttagacaaaattactggagatatgcaactctagacacactaacaaaagaanttaaaggccaaaagcaaattataagtacttatgccaacata

SEQ ID NO: 8767 - DNA, 308 bp, Diabrotica virgifera
  Clone ID: pGUT3090
gcccccgggtgccggggggttaaataaaaaggctctttttttttctcccccttaaaaacgccccaaatttacatttttttgggaaaaaaaaatttttaaagaacttctttggaaggaaagggctccccctttaaacactttccacactttttaaagaaaaaatcacattcttttttttccccccttatttttaatcaaccttctttctcttttcacctttaaattttttgggggggggccccaaaaataaaatttttttaaactttactttttaaccacacatccgggttaaaactccccctttttca

SEQ ID NO: 8768 - DNA, 186 bp, Diabrotica virgifera
  Clone ID: pGUT3098
ccaacgagtaatgacccagatggttcctaccacacaagaacgtttgtggcaaactcaataccaaactctaccacgcgtgtattaaaaattgctttatttgtaatttgttgttaaaatgtttgttataattgttgaagatatataaacatttgttttttcaaaaaaaaaaaaaaaaaacttgggggg

SEQ ID NO: 8769 - DNA, 211 bp, Diabrotica virgifera
  Clone ID: pGUT3108
attggagggagggaaatttgcggggggcgtaggggtcaagacattttatgccccttccaaaaaaaacaaaaggagttgcgccttttaaaccagggcaattgttttttccaatttacaaaactctgtttaaaaacctcttggggaaaaaaaaaaaaaaaaaaaaaaaaacctggggggggggccggccccccaccaccccctttgggggggg

SEQ ID NO: 8770 - DNA, 409 bp, Diabrotica virgifera
  Clone ID: pGUT3118
cgagttgttggtagtgcattggcatcagttcctgttgaatgttgtatacaaatcctaccaattgttcgatttgctcttgagataattggttagggaaagcattttggtattgtacaatgtggtttctgatttgttcttgggaccatggagcttgaccataatgatggtacaattcatacattacatggtacataagttgtctttgagacccatggatattgttggtgagacattggactttgttcaaggtaattttctaattgggggtgtacttgttctaattgttggtagtgccttggtgttaattcttgttgaatgtgggatacaaattctacccattgttcgatttgacccttggataattgatgaggggaaactgaatgggactttacaatttggtttttgattt

SEQ ID NO: 8771 - DNA, 280 bp, Diabrotica virgifera
  Clone ID: pGUT3121
tcgccttctaaataatcggcctttacgggcaacatcatcttattccaccgttcgttacgtcaacaccatgtaactcatatttttaacttaaataaaattcaataggacttttattaatttaatgtgcgcgctctggatgaatatgtgtccaattcttttcatttctactaacatcgagagaatttgggcttactttcaacgaagattggcatgtatttattagagtctgtcatgtgtgttttctaggaaaatggaagcagtaaacctattgtacattgtt

SEQ ID NO: 8772 - DNA, 202 bp, Diabrotica virgifera
  Clone ID: pGUT3129
cggcacgagagcaagaggaaaagagacagaaacaagaagagaagagacaaaaggagaaagaaaagagaaaacaaaaggaagaagaaaaaaggataaaagaacaacaaaagcgagaagaggagcgacagcgtagagaggaagaacgtctgcgacgggaagaagaaacagcaaaaagaggaagaaaaaagacgaaagcaagagg

SEQ ID NO: 8773 - DNA, 439 bp, Diabrotica virgifera
  Clone ID: pGUT3134
gtttactctcagtggtggaaaacgtgaattgggtgaccacgtgaatgaaattgaacatctaattgatgagtggattggtttgccctggacagagttgttgaacgatgaggttgatggtgtagagatggtgtctgaaggtttgcctaaaaagatagatgacttgttgttgcttccagttactactatgggggcggatgagagagagagaatcttttggggaggaggtaaagctcctgccagttagaagaaagctggatcattcgctaacaaggtgttttacacgagccctgagtacgtttgtgttggggagttcgtggagaaatgttaaaggaggttgcatgaagagtggggttaccaagaggttgcgggtgagattggtgcaactgacttgagagtttgatacttgggcagattttaaaatgttggggccaggttaatt

SEQ ID NO: 8774 - DNA, 305 bp, Diabrotica virgifera
  Clone ID: pGUT3137
aaaatggctcaatcctgggtgaaaaaacgggggaaggggcgccgctaaaatctgttaaatttaaacggtacccttccaaaataggtttctgaagtgatgggttttaaggggccttggggcaaatttccccaatattttgggctttgacaccgaaaaaggtggaccattaaccccccaattgtttaaaagggagctttgttcttttttgtaaaatgttgtgggtaacaaataaaccccttagggaattttcccctggtttttcccaattttgatctggcccaaaatttggtgggtgagggaatttg

SEQ ID NO: 8775 - DNA, 303 bp, Diabrotica virgifera
  unsure (1)..(303): unsure at all n locations
  Clone ID: pGUT314
atgaaactgatagtagtgattttagccgcagtttgtctctacgacgtatctgctaaacaagatgactacgtgcaatgggtgagttatgatggtacaatacccgccaatgttgtggaaggaactacatccattgatggtagacaatcatatattgcccgtgcctatgttagtttagatgagtctgatctntataatgacaatcaaggttacatantaggcccactggaagcaggagttttacaactcaatgctagttttcctgatntaacttatcatattaccgacnacattgagaatctaact

SEQ ID NO: 8776 - DNA, 575 bp, Diabrotica virgifera
  unsure (1)..(575): unsure at all n locations
  Clone ID: pGUT3146
caacaatgctagctgctaaagttgtcttgtttttgggccttgcccttttcgtctgagccggtgaagatcttgacaagggttatgaaattgtggaatgtgccaattatgtaatgagagcaggagtacccgaattgggagtaccacaacacgacccctacgtcaaactcagggacctacaatggagtggaaacctcggtgttgccaacgcccatatcgagctccatgataatagatggtatggtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccactgacttataacctaacaccactgtagacagttntaccgtcgactggcacgttgcagatgtaaaatgcaaaatcactggtatgggattacttggagacacttatgctctcgct

SEQ ID NO: 8777 - DNA, 121 bp, Diabrotica virgifera
  Clone ID: pGUT3151
gattcggcacgagctctctctctctctcgctctctctctctctctctgagtgtctctctctctctctctctcgcgagcgcgcgcgcgcgctcgcgcgaaaaaaagagagagagagagagag

SEQ ID NO: 8778 - DNA, 284 bp, Diabrotica virgifera
  Clone ID: pGUT3156
ctcaagtcttgaaaaaatcgaatcctgcaaagctgtgcccactgaagttgaaagctgggatcacagtaaacagcttcctaccactgaaaacatttgcacactcttgcccaaaatcaagaaatgttcctccgacttccacggacagtactgcaagaacccagtcactcttagctctttcgccaaattccacaaagccattgaaaccgagactgaaaaaatttgccacgaccctgtcaaaaacgaagtcgcttaatttatgaatgttaatttttgttaaataaatt

SEQ ID NO: 8779 - DNA, 497 bp, Diabrotica virgifera
  Clone ID: pGUT3159
ctagtctcgagtttttttgttttttttttagccttaggttgtttaattttatgcggcattattctaaatttaaacggggaataaatatttttcctagtctttttactcaaattaaattggccgaaaatcctttgggaccttttttaacaaaaaactttttttctttttcgaaaggttttaagctgcccctttgtttacacaccaaagggggccattacaatttttatttaataccattcccaaattttggaagataaaattaaacccccaccccattattttattggtttttaacaaatacatcccacctttaaatccaaggttccaaaggttttttaaaaagaaatttttctttaccttttcccaaatttatttttaaaagagatcttttttaaaaatcttttagttttatgacaaatattcggccgttcacctaattaataactttaaaaaggctttagacccttttccttataaataatcggaaaaaatataaa

SEQ ID NO: 8780 - DNA, 291 bp, Diabrotica virgifera
  Clone ID: pGUT3160
gttagggcatagataaaaatttgcgttattaaatagttttatttccattttaaagcatttaatactaaaaacagcataaaattacagttttacgtgtctattacttaagttaataaatatcaaatatgccacgaggaaaattcacaaaccataagggacgtaaccgtaggtttactaatcctgaagaattagaggagaaaacaaaagattactaataataaaaacctttgggggggggccgggccccaaatcccccctaagggggggggtttaaaaatccccgggcggggg

SEQ ID NO: 8781 - DNA, 473 bp, Diabrotica virgifera
  Clone ID: pGUT3162
cggcacgaggaagtatgcatattaataaaatattaaatgcgtacgcgcgcattatcacatgttttttaattgtttttaggtaaaacagtaattgttattcataaaaagacagtggcagacaaaatatatctcaatagacagctattcagataaattgtaggttatgtaaggttaggtgaaaccaaaacatgttctgacaagtctcgctccatagggcttttcattcagtcatttatttcgagcttctgtcataatatgtggtataatccgtgtatattaatattatacacagattatccctctagcaggccaattttattttcaatggaaaaattcaaagcttgatatcttttgacttaatagagccaatcaattagcgttaaccaaatatttacaagtacacttagtagtatacgaccaaaggcaggtttgcatgctgcatacctaaacatagctgaaatagctagaaatta

SEQ ID NO: 8782 - DNA, 473 bp, Diabrotica virgifera
  Clone ID: pGUT3166
cagcgttcacatacacatatgttcatgtaatattcaggggtgacatctttcagagtgcggtctttacttcgcctacataaaaggacttatccaaggtttcgttcatgacaactggaacgcactatatttgaatgtattaattctcactcacatatatatatttattattagtggggtgacattgtaccgatatattaattacactaagacattttttatacatcggccatttataatttttaatgttttttacaaaagtcgcttatcgcttagaactgataacttttaaagtcacttataattaataagcacatattggtgatataagtaacataaattctttaatacatgttatgtttaaacttatgtttaatgtaaatttacaattttctttctattttagtgatataaggcagcttgaaagccaaacagcactatggaatattttacagtaactgaaaattgaaaatttt

SEQ ID NO: 8783 - DNA, 354 bp, Diabrotica virgifera
  Clone ID: pGUT3169
tataaaaatgaagcaaatacttattctttcaattgtgtgcgtacttgcagtccattttgtaagttccgttagtctccaaaagggtacacttgatatcatagagggcaattgcaccagtccaaatccaaatccaaaacagttgaatggcacggtgatcaaaaaatttactgcgtaacagccatcagtcttaagagcgccgaaaaaggttcaactgcttggatctcagatggtggagttaaccacacctacatcgcaatcgaactggaatctggtagagggcatggcttggaatacaacgttaccatttatgctaaataatgttattgaggtgtttaaaagagtttgtgtgattat

SEQ ID NO: 8784 - DNA, 261 bp, Diabrotica virgifera
  Clone ID: pGUT3172
ctccaccgacgccccaacaacagctgcaccatacacaaatgcaccctcaacagctgcaccatagacagatgcaccctcaacagctgcaccatacacttatgcagcaccagcccttttttaagcaaaaaattaatttaaaaaataaccaagaatatattttcctccagctttgtaacgatagaatacaataaaatcgtatccattatttactagaaaaaaaaaaaaaaaaaactggaaacctcgtcccaaattcggcacggg

SEQ ID NO: 8785 - DNA, 307 bp, Diabrotica virgifera
  Clone ID: pGUT3173
aaaaaaaaaaaaattttatttaatttttttttttttttaaaaaaaaaaaaaaaaaaaatttttttttataaatattaaaaggaaaaaaaaaaaaaaaaattttgttggtggtggaagtttaattaaagcccccccaataatttttaacatcgtcggtggggggcgaccccaaatgtttttttttttttataataaatctccccccctcttctcctcaatttgaaagttggtttgtaaaaaaaattcttttttatttatttccaaggttatttgtaaaggaagacccttctaaaattatttttatttt

SEQ ID NO: 8786 - DNA, 358 bp, Diabrotica virgifera
  unsure (1)..(358): unsure at all n locations
  Clone ID: pGUT318
ttataacatatattattataataaaaactatcgataatacgtgtgaaaattgccaaaaatagcaaaattccaatcaaaaattaggttggagaaaatataaccctcaaagttcaaaatcggtataagttaaaaaaatgcagtttctcggcattccatggagcaatttccttcattctttttttgttcccaagtatctcaagtagagccatcgaactaacgcatntttaaatgtcaaacttgcctttgttttgttataataaataaaattatntattataacacaaaattttaatttgtctaaataaaaactgtttaaataactatacagctttccaatgagaatatttatatttttaac

SEQ ID NO: 8787 - DNA, 99 bp, Diabrotica virgifera
  Clone ID: pGUT320
gcgacatctactaaaaaattgaagatatctcagatgcaaaatccaccaatttaataaattaaaatggtagatagtattttagaactgagaattttcgtg

SEQ ID NO: 8788 - DNA, 449 bp, Diabrotica virgifera
  unsure (1)..(449): unsure at all n locations
  Clone ID: pGUT3210
caaaatcctgaattagaaaaagaaggctgaaaaggctccagcacctgcaaagagatggaaccgtaggaagcttactttggctgaacgcaaggaccgtgttgcacagaaaaagaagtcctacttggccaaactccaagatcaagaatcttaaaatgttcttaaatttaatattgtgtagtaaaatacacaaataaattaaaataacactcttgaaaaaaaaatcccagataaaaaataaaaatctggggggggggcccgggccccaaaaggccctatgggggggtggtttaaatctcctgggccggggtttaaaaagnagncnacaagattataattggtgaaagattcaacttcttcacaaactctggtaacatctctgatcttcctagtaactggagcttccaactgaagagcttgttttaatgcacttacaccatttgtcccaagtg

SEQ ID NO: 8789 - DNA, 579 bp, Diabrotica virgifera
  Clone ID: pGUT3236
acctcctgcccaaattcgcacgaggaaaaaaaatatatttgggtttaaatgttaaaagagtcgataaaaaaagtgagttttttccttataaacaattataatatctttgtcatttttaagataaataatagggatgttcacaaaaaattaaaaagtcatttcaaacatgtaaaacgattaagaaacaccctaggaataattgtccaaaatttcaacaaaattggaaaagcctttctataaaaaatctttattagaaatctagcattattttaaatttcaagaacgcttctctattggcctgacgtcactagttgcataccgcaagcgcgcgctattctcatagtgtaactgtttacctgtttgacgtttcaggttattttattttgttctcttcttgtttatcagggttaaagtggagttttatagtgaatttgtttagtttacagtggatagactgtttgtaaggacatattttgggttttacaaaaataaacacataaaatggaagaaggttgtcagaaaaccgattcgtataaacgaccgactgtagtgtagatgtaacaatggtgtttgatttat

SEQ ID NO: 8790 - DNA, 175 bp, Diabrotica virgifera
  Clone ID: pGUT3237
ccgtcagcgcccaaaagaatgactttttgtgcgatacctgcgtaggaatagtaaaagtagtccaggactacgtacgaaaagaaattccattggaagaagttgaaaaagaagtgaaagaattgtgcaaagttttaccaggagatttggcaaaaacaaaggtagtcttcagaattta

SEQ ID NO: 8791 - DNA, 240 bp, Diabrotica virgifera
  unsure (1)..(240): unsure at all n locations
  Clone ID: pGUT3242
aagaagaaagcttctaatggttccagtcttttttttattttagttgaaagttttgtttcaaattgattgttccggaaaataatattgtacacaaaatgattcaatataagattttaaaactcanaaaaaaaaaagaaaaaaaaaaaaaaaaaaaaaaaaaaaaaaaaaanttttgggggggggggcccccccccccacccccctttaaggggggggttaaaaaactccggggcggggttt

SEQ ID NO: 8792 - DNA, 244 bp, Diabrotica virgifera
  Clone ID: pGUT3246
ctacgacgctcaggaagatgctacaagattcgccattttcaagactaactacgaccagattgaagcacacaacaaaaagttcgaagctggtgaagtaacatggtccatgggattgaaccaattcgctgacaggaccccagaagaactaaaacatcttcatggactcagacgtcccgtaggtggtagtggagtacattaaattagttattaataaaaaaaattttaaaataaaattatatctttg

SEQ ID NO: 8793 - DNA, 518 bp, Diabrotica virgifera
  Clone ID: pGUT3254
tgcagatgaaactacaactgaaataagtaccactgaaagtaatgctgctgtaaatggaactgaaacttgtctcagaaataatgttgtctgcccagttgttgacggatacgattcagtctacgccgctttacctgactgctccaaattttgcctgtgcctgaacggtgtgccattcgaacatcaatgttcagatggtctgctctttaatccacgatcaaatacctgcgattggcctcagagaacgtcttgttctggtgacaataacgtaaccacttctgcagttcccgctgtttcaaccgaatatcttacagaagaagaaacaacagtacacagtagttcaacaagtaatggtgagaataatgtaacaggttctgtagttcccgctgtttctaccgaagatcttacagaagaagaaacaacagcacaaagtagttcaacaagtagtggtgagaataacgtaacaggttctgcagttcctgccgtttctactgaagatcttacagaagaagacacaacag

SEQ ID NO: 8794 - DNA, 480 bp, Diabrotica virgifera
  unsure (1)..(480): unsure at all n locations
  Clone ID: pGUT3257
cttcaaattagttagagcacgccatatgttctcgtagctaggcatgtttgtataacacttcttggtcaccatataaagcaaagatcgagaaccatcttctaatcgcagtacttttccaactttaggctgctgatttttaactcgttcaggcggccgaactttctattgaatacggacgagattcctttagtcatctcgactacttgggcaacacagtgggctaaagagacgttttctgaaacactaaacagatcttgctgaacttctatggtcacgccgaatctagcactccttttctctgcgtaattttacataaattccttaaaacttggctgtgcggcatcttttatctcctgttggaggactcgggcttcttctgtttcatttgagccagcatatggtgcaagatgatttatgtgaatatcttttggtttaccgtttggcaacttcttaattntggatattacgtcatttattttc

SEQ ID NO: 8795 - DNA, 566 bp, Diabrotica virgifera
  unsure (1)..(566): unsure at all n locations
  Clone ID: pGUT3264
gcggcttcgatgcgtccttgagttcggagacgaggttctcgcgggaaactaagtctactgagacactctctaatctttctgttgctttcctcagtcgttcgtaatccacagttccttgtacggtaagaagctcgaccatgaagtccgcctcttgtacactctgctgcaccaactccaactgccgctcgaacctcttccacaaggccaatctgcttctcagaagagccaggatatcgccgcatctcttctccaaagctgtgtggtcatcctgtaatttggagatgtctctttcgacggtgagtggagacactgacaccttcagtctagttggaagaccgtgaagtagttgtctgatggccattaagtcttgccataaagttactagttcttctcctacttcgtagcattcggagactgacttctcgatcgagtcgctgcctagtttttccgagctttcacaaaggtctagtctcttactcatttctccatgtttccttctaactcgttcaatgctcttttgaatggcttgaattgctcttttactaaagttcctccttccagntctt

SEQ ID NO: 8796 - DNA, 351 bp, Diabrotica virgifera
  unsure (1)..(351): unsure at all n locations
  Clone ID: pGUT3266
cagatcaccctggttcaggggtgggggaattggggaatgtattacaattggggaatgcagacccctttcaaaaacagttagattcaacgtattgaaagtaactaaaggtagcagttcaaagaagagcttcaggaagttttgagtgatgaaacatttttaaaataaaaatcttataaaatgagaaaaaaaaaaaaaaaaaaaaaaaaattaataaaaagaaaaaaaaaaaaaaaaaaaaaaaaaaaaaaaaaatnnnnnnnnttttttttttccccccaaaattggggggggggggggggcccccccccccccccccctttgggggggggtaaaaaaacccggggggggggg

SEQ ID NO: 8797 - DNA, 330 bp, Diabrotica virgifera
  unsure (1)..(330): unsure at all n locations
  Clone ID: pGUT3268
gggttgctaattcatggaatgaagattggggagacaagggattgtttaaaatacttcgcggagaaagtgaatgcggtttcgaggatggtgttgttgccgcacctgcatatggttaatcctacataaacaaaatattgctataacgtttagttatgatttattttataataataaaaattgtttcctaaaanaaaaaaaaaaaaaaaaacaaaaaataagaacaaaaaaaaaaaaaaaaaaaaaaaaaaaaaaaaaaaaaaaaaantntcggggggggggggggggcccccccccccccccccggggggggggggaaaaaaacccccgggg

SEQ ID NO: 8798 - DNA, 516 bp, Diabrotica virgifera
  unsure (1)..(516): unsure at all n locations
  Clone ID: pGUT3271
tcgagtnnannnntttttttttctttttttttttttttttttttttttgggggtttttttttttgtggggggggaacccccccccacttttttttttttttggggggggcaaaaaccccccgccccattttataaaaaaaaaaaaatttttttccccccccctccccccctaaaaaaaaaacgggccccccccccccggggggaaaaaaaaaaaaattttttcttctggccgggggggggggacaactttttttttgtgcccgggtggggaaaaaaaaaaaaaaaaaactgtggggggcccccccccccctaaagggggggccgctttttttttaaaccccccccccttaaaaaaggggggggacccccccatttttcggggggttttttataaaaaaaaaaaaaagccccccccccccggggggtttaaaaaaaaaaaaaaaaaaaaaaaaaaaatggggggggggggccccccccccccccctcccccgggggggggttttcccaccccccccc

SEQ ID NO: 8799 - DNA, 137 bp, Diabrotica virgifera
  unsure (1)..(137): unsure at all n locations
  Clone ID: pGUT3288
gcangcgtagcangtgaaaccgctgaagaatctgctgttacttttttcaaatgtcttcattcgcaaggtccaccacatggtcatggacaccattaaataagttttagcctagaattagcgtaaataaaagattatat

SEQ ID NO: 8800 - DNA, 576 bp, Diabrotica virgifera
  Clone ID: pGUT3292
caaaagtgtatccggaaccattaagagaactgattggacatatgttcaacgcttatgtttataccactaagcaacaacgactgtacgctggagctttgttagattccatccttaactactttgacaataaaataaacggttcagtatcccaaaaattcaaaatgtacagcggacatgacctcaacgttgccggtatattaagagtgtttggtgcatttaatccaccctatcctccagattttgcgagcagtttatatttagaactaagaaataattcaggaagttattttgtaaacgcgtggagcaaagatggatccaacttcaaccaggtttctataaagggatgtgctttggattgtcctttagatgaagttagacaaagattggatgggatattacttgacgttgataccaaagtcaaagagtgcaatgctaaattggaattcgaaaatgttgatgtagaaaatatgtacaaaaagcttaccgaaactggtgaaatggaacgacttaaggatttatttttaaataaattatagatagtaacacaaaaaaaaaaaaaaaaaacttcgagggggg

SEQ ID NO: 8801 - DNA, 652 bp, Diabrotica virgifera
  Clone ID: pGUT3294
caaggatagaaattatttccatttattaattgtttaataataaaaaacatttcccacctagctgggattcgaactctcgacctttgggttcaaaggtaggctctcttactgagccacgaaggggttgatttgaatgaacttacacttacaccacgtttacccatgaacgaataactgacgataaatgtcaatagatgaaatccattttgcattttaaaaaacgtagcacagcgaccgagacctccatcttcgaaggctggctaggccgacactgagcaatgcagatgcagcgaggggaaaggggtgggagagagagagagggagagttgtaaggcaatgttgagagattgagcaatgcagatgcagcgaggcgaaagggttgggggagagaaagagggagagttgtaaggtaatgttgccagatttctcccagcccgtcacactctttctcagtgacatatggaaccttttttcacgaataaatttttaaaaattatcttgttttctccggttttcccggtttagttgtggatcacgtgagacggaattagtaggaaaaataaaaatataaatttaaactttaattgcaaacagcacttccgaaatgtcatttacaaaaaaatcttgaatttttgtacatacctaaagtttt

SEQ ID NO: 8802 - DNA, 505 bp, Diabrotica virgifera
  unsure (1)..(505): unsure at all n locations
  Clone ID: pGUT3302
ctcgagtttttngtgggttttttttattttttggggggtcttttttttttttttttaaaaaaaaacaaaaaaaaaaaaaaaatttttttttttttgggcccccccccccccaaaatttttaaaaaaaaaaaaaaaaacccccccccgcccccccccgggttaaaaccaaatttttgaaattttttaagggcccccccccttttttttttttgggcccccccctttttattttttttcccccccgggggggggggttttttttttttgttgggccccccccaaaaaaaaaccccgtttttccccggggggttttttttttttaaaaaaaaaagggggggcaaaaatttttttttttttttttttattaaaaaaaggggttttttttttttttcccccccccccaaaaaaaattttttttttaaaaaaattcccccccccaaaaatttttttttttttttttttaacgggggggggggggcgcccccccccccccctcttagggggg

SEQ ID NO: 8803 - DNA, 507 bp, Diabrotica virgifera
  Clone ID: pGUT3305
gggacgactcgtgccggtcgtggcgaattcctcactagtcggctccagttagcactgaggcgattgctgctctctttctgcgtttctaccaacacaaaaatgaggttccacactatttttgagcacgtcgacgagctcgctacagtggaagttgatctgtcggggctccatgctcatggaggctccgatagttctgttgagtaccacatcactaacgactatacagacagatgcagagagttgattttaaccaatgaaaaactacgcaaattgatgaaagtctttttgcgaaaatgttcacagaggtttgaaaaaagacacacacccaacatcggatcgagaaatgtgttccaacatacgtgcaagatcttccagacggaacttaatacggctaatttctagccctagacctgagtggcacgaactgtaaagtcctatctatcgatctcacgggcgaacactttgagatgaaatccaagatcttttccattcccaacacattatgtt

SEQ ID NO: 8804 - DNA, 308 bp, Diabrotica virgifera
  Clone ID: pGUT3306
ctcctttgttgccctttaaaaaataactgaaaatttcctcaaccttctttttaggattttttttagaataaactaggttcagacaaaaattttttcaagttttttttgtttttaagcccacattcaaaagggctttttctcctctcctttttttgtggaagaaaaccaaattgggcattttttcctgttttttttttgcgaatgttgcccaattttccaaactaatagtttggaacaaataaagaattaaacttcctttaacaattttttatatgaatctcgaaaatggggctttttcttttttaaaa

SEQ ID NO: 8805 - DNA, 212 bp, Diabrotica virgifera
  Clone ID: pGUT331
cgttactagaagtgcaatcacataccgttcatatagatggccaacataacaatataaactgacgtgcaagacttggtgttctcacgattgttgataacatcataaatagtgcccacgcactagtggacaaatgaggtcatgttgcattcaacacacttgatacggtcatgataaagtaacaaccgatactggtcatcttagatgcgggttgc

SEQ ID NO: 8806 - DNA, 136 bp, Diabrotica virgifera
  Clone ID: pGUT3316
caacagctgcaccatacacttatgcagcaccagcccttttttaagcaaaaaattaatttaaaaaataaccaaaaatatattttcctccagctttgtaacgatagaatacaataaaatcgtatccattatttactag

SEQ ID NO: 8807 - DNA, 547 bp, Diabrotica virgifera
  Clone ID: pGUT3317
gtgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccaccttgctaaagtgctagatgttacaaggaccgtgcttactaaaatcgctcaagcacttaaagttgttatagataaagttgctgaacaaagtgatgatgctggaaagaaattggtttcctgtgtcgaacaacacgaagcagatctcgtcaatatccgcgtcgctttcgtagaaggtgccggcaaatgcgtgaaagatagcgtcatcgctttggttaacactggcgcacctttgctcgaagatctaactgaaatccataagcaagcaagagacgccgccgaagaaattgacaattgtgaaggagataatgcagctggtttgctctgcgtttttcaggtcgccatggatattctttaaagtgaccttcagaatcccgaagct

SEQ ID NO: 8808 - DNA, 232 bp, Diabrotica virgifera
  Clone ID: pGUT332
gtaatgcaccataaaagtcttaacaatagcaaaaatgtatttaacttatcatttatgtttgaaggacgttagaaaatataaaattttttgattaggaaaaaaagaaaaaagaaaaaacacgccccatatgaaaaaagtaaaaaaatctgcaagggggggcccagcaaccgttgcaccctattctaattcatattactctcattggccgtcttgttacaccatctaaatcggg

SEQ ID NO: 8809 - DNA, 210 bp, Diabrotica virgifera
  unsure (1)..(210): unsure at all n locations
  Clone ID: pGUT3323
ccangttttgctagaaaaggaatcagaagttaagctgaatgatctttgatttcaaaatgtactaactgttaatatgcaatttcaaaaaataccaaaaaattttcacatgtaaatgtatttatttctagattagggatttgtgtataattttttagataataaatcttttgtaatatagttacaagctggggtcttattggtgtaaggtac

SEQ ID NO: 8810 - DNA, 282 bp, Diabrotica virgifera
  unsure (1)..(282): unsure at all n locations
  Clone ID: pGUT3329
aaacaggctagagaaagacgtgaggaacgtatcgccacaaagaaacaagaagttttgcagaactacatgagggaggatgaagctgcggccactaagaaataagttaattgttttataagatgactatattaaaaatttaaaaaataaaaaaaaaaaaaaaaaaaaaaaaaaaaaaaaaaaaaaaaaaaaaaaaaaaaaaaaaaaaaaaaannnncggggggggggggggccccccccccccccccctaagggggggggtaaaaaaaacccgggggggggttt

SEQ ID NO: 8811 - DNA, 571 bp, Diabrotica virgifera
  Clone ID: pGUT3341
cagggggccaaatccgcaccaacccgagctaaaaaaatatggggaatgggcaactggaggaggacagagattcttggaggcagatgctgggggaggccagggtccgacttgggctgtagcgccataggaaagagagagataagctagttatcggagagaccttaaattaacatttcaaagacaaaggggatggcagttggaaagattaatatagatcaagatgtgtttcctcttaatggagaggagatggaacggcggatccaaccttgcaaggtgggggtaatgaaatgcaaattttctcgtgtctggcgtacgcaggatttttttcgggatgggctgttattttcttattcttcatgtaccgtgtcctttcagaacgttggttaacatcataggtatcttaattttatttattgccacctaaattaacgttcttcttcgtcctggactgcgtttgcctgctattttcacttgaataatattttgtagcaacctatatttgggacctctcattaaacgtcagaaataatccagctatctcttcttgatgcttcttataatcgcagtagtc

SEQ ID NO: 8812 - DNA, 237 bp, Diabrotica virgifera
  Clone ID: pGUT3355
gaactattctcgagttttttttatttttttatttagggaatctcaaagggggggggggtattatcattatatcaaacaaagggggggtcgttagtaaaaaaaaaaccccccccccaaaagtttcttcaaaaaaaccaactttttttaaataccctcatgatacatttaaaaaaaaaaagacatatgatccaccaacaataaaataaattaatctactttaactaataatcaaccaaa

SEQ ID NO: 8813 - DNA, 272 bp, Diabrotica virgifera
  unsure (1)..(272): unsure at all n locations
  Clone ID: pGUT3361
cataactggagtatgctcgcatcanaggtcttttggctttctaccgtggattcttttacttagtgataagtttgtgagttacaaatgtgacgacattattggttccaaaatgggacgggccaaccttaagaagattattagtccattatgggcccggttacttcccaaatatattccaaagcgagcggtgcctattttctggacacgaatgataaacctccctatgcccagggttaaaatctgagattgtgtttatatttctcgtgccgaat

SEQ ID NO: 8814 - DNA, 176 bp, Diabrotica virgifera
  Clone ID: pGUT3362
acgaagttgacactgacacagtaatggacaaatgcatccaattgaaaaagtgtccagctagtggaagttattaacgctattatttttctaaataaaaatatattgttattctaaataaaaagtgctgatgctaatagaacataaatgcattttataacaaaaaataaaccaatctg

SEQ ID NO: 8815 - DNA, 584 bp, Diabrotica virgifera
  Clone ID: pGUT3374
gcaatatggaaggttttctggagtacttagacataaatacgtaggaagctaaagttataataaaaatttagtaatgctaaaaccacatagcctcaatagaaatgctgtggttgctaacctcaacaaaagagtatattatcaactttcgaagtttgaatatctagctagactataacaataataacgaatgggactgtgacatagcgcgttaggatatggatagaataaaatttgttgcacttaaaaagcaataatgtagcattacggattacgggttattatagtcctgcgaacaaactaagagagtcgttaatattcagctcaacggggtacgattgatggaattatgtacttaaataaacgagggatcattttatataacaggtagatcccttatcgatagaatttcacaccttgaagaatagcgccccgctgagcgaatattaataactcttagtttggttgcagaactttaaatgctatgttttttcttaattgaaccagtttttttcttaattggagatagaggggctttagcagcttttaaatagtattaaaaaaaaaaaaaaaaaaattggaggggg

SEQ ID NO: 8816 - DNA, 667 bp, Diabrotica virgifera
  unsure (1)..(667): unsure at all n locations
  Clone ID: pGUT3379
aaatctttggcaaacccccctagggatggttttcttggcaggtgcttattactgcgcccacaaacctctcataatgtttgctggttggagggacccagctcaagatccggtctagttgttcagagaacttcttccagtttgcttttctaagattccacctgggtcgaggatatgatctaattattggaattgatattccaatggtgataagcaccggacgatgttgagtatgtagatgtagatgtaatgtatgtagattaaagtttttaaacatttgcattagacttcttttttaagcgctacctccaacagcaaacttcaaggtccttggattccttccgtggatacatggaaggtccataggaattttaacttttgatgttgttggtcgaaaaagtaaagcagtttgattttaatactgattaggtatgtctgatttctttatgtcattgatatacatattttgtgtagcatcaagtcctttttatgaagcaattaagaattactagtttgtgattggtagaagttaacataataaatggtgaacatttaaatggtaagtatatcctatttatcgatctgctntaccattggtggtaacattaaagttaatcataaatttacaagagaaaacgtatcttaaatactcaattgcagatgtgatttg

SEQ ID NO: 8817 - DNA, 465 bp, Diabrotica virgifera
  unsure (1)..(465): unsure at all n locations
  Clone ID: pGUT3380
gtaagtaccaattagtgaaattaaacacacagttgttataaatatgtattngcggttgagaagtcatcacttttataatttttaaaatatttgtcattaatgtcactgaatgtattttttcgtagcaacgaagagcatctgacgtaatatgcttaacgacgggagattatcaaaaattatcaccttaatttgcatgtctgaagctttctattggtcagaatctcctatgaatgaaataatctttgtaatttctcactttttatgattgttgtaactctataatttttctaaataagttcgtcctagccacagagtttccaaaggaaaagggatgtcatcacgcgttcttagcagtagactaataagcaagacaatgcgcagtcttcattgagactcggaacccgatttttgtccacaacaattggtgtttattttgtaatgcaagaataggctagtttaaaatct

SEQ ID NO: 8818 - DNA, 630 bp, Diabrotica virgifera
  unsure (1)..(630): unsure at all n locations
  Clone ID: pGUT3381
ggctgacggcagaattgaataatgagcgaaggcgttagtccctggaagaccaaccaccatgacatcggcatgctaatgttgaaagacagaagagaaaagataacgaacgccggcaaatactccgatcgttacaaagacattttttcgcatgaagtgcccgacgaagaaaaattccccttaagtgctaagtgtcgcgataccatggaacactaccgtaaagtgtcaaaaggggggaagcccgaagactcccctaccgcggtgtcaaaactgaccacggagaaaatgaagcttacagtaggtaagaaaagtagcaacgctaccaatgacctaaataaacaagagaatgctttaataggattcaagcacgtaccggagggtacccacaagccgaaccaacccccattgccactaagttcaccgaacaccaccaagtggcagaagaggaacgtcaacgtttacagcgtcaacacaaacgttccaccttctagtcctaatcaaatcagagcacctccaggattccctcccaagaaacctccacctgtagctctaagcgcgatactcaacggaaacaacaacnnacaatatatcactaataacaacaaccactttcgatatactntatcgcatcta

SEQ ID NO: 8819 - DNA, 673 bp, Diabrotica virgifera
  unsure (1)..(673): unsure at all n locations
  Clone ID: pGUT3386
atttaaacttcttttctactaaagtattctaatttatggtgtacttagttcagaggtgtgtgaattaatgaaatcatatattaaatattgtcaatacaaaaatccttcatatgcgttgcatagtgaaggtttttagacttttgtgattatattcactaacaaaatctgaaaaacattgttaaaattatccggtacattcaaaattgttgttacttttgatcaacattcattgaaattaccaacattgattgatctgcttaattaaatcagatctattgctcaatgatctattttagcttgctgtgtgctgttttggaaaatatttgcttacttttcaaaagcgcaattttgttcctgactgctgacgtggtccttagggccgtattgataaattcaacaatgaatattgatcaatgtatatattttgtaaatagtatttgtattttaacttattttttattgtgagttgatttttgggaggcgaatattgctcatcacaagattaaaattagtgtcataccggttcttgagttacctcattatttattaatcttcttgttcaacgaaatgttattttaaaatgcgcaatattggaatgtcccaaaacgttctttgaggaatagttntgttagcaataaatttttgttgtgattttgggacaggggaggatatg

SEQ ID NO: 8820 - DNA, 178 bp, Diabrotica virgifera
  Clone ID: pGUT3389
tgcacgagtgttgccgcacctgcatatggttaatcctacatagacggggtattgctataacggttagttatgattttgtctcacaccggtttaaactcagattataaaaaaaattaaaaatagccctgaggggggcctgtaccccctacccccattataaactttaattcaaccggca

SEQ ID NO: 8821 - DNA, 582 bp, Diabrotica virgifera
  Clone ID: pGUT3390
gtacaaattaacaattttacgtaacctgtgatctttttaatactgatctgcttgttgattaaattaaaactacgtcaatcatttagcggtttctggcgttactgccacatactgcctggtttttccagtcaccaatacacaactttattacccgttttggtgttttttttataaattgcagtgataacaaggattgaaaatggttcgttctcatcatgtagaaggctatgataattttgtcaattttatgaagaacttcaaggcacaaggaaccgtagtttgtatttattttggtggctctgtagacgaagcgactggtgaaagttggtgtgatgattgtgtaagggcatggcctgtaataagtaaggtacttgaacagctagacgataatgtggatttcatacatgttgaagtaggagacagaccaacatggaaagacccaaacagctccttccgtaaagatcccaccaccaaactgctcgttttaccaactttgctcaaatggaaaacgccaaaaagacttgaaggttcacaatgtgaaaaagagttttggtcaagatgcttttgtgcgacgatgatgat

SEQ ID NO: 8822 - DNA, 631 bp, Diabrotica virgifera
  unsure (1)..(631): unsure at all n locations
  Clone ID: pGUT3391
gtctaaactagggtcccccggctgaggaattcgcacaactctgccaattcgcacaactctataaaacctctattcttctctgcgcatgcgggcgcccgggaatgccccgatcgaatccgaaggctacatttgcctccctggatgtctcactacgttatcccataacggcataggcaattatgtttgcggttaagttgttacgacgtttcgtgccttttcatttgatcagtcgcagtataatatacaagagaagagggaaaacaaattttgatttattttgcctcgtacgttacaatacctgtgctatcattgtaaataattttaaacatacttagaagcctctatttcattttcatggcgggtcaccactattattaaattaattgtatagttagtagaatttaggttaccgtttttcttttaatataaaagctagactctattgagcctaggaagtatttgaataaagttaaaaaagtagcacaatntatttttaatttcacacaaatactgtacatttgttttatcattagtgtgttatactcgatatatcattttcatggccttacgaaggctnggtctcttttataaacacatggttcgggaatgttatttttgacaatttttttga

SEQ ID NO: 8823 - DNA, 510 bp, Diabrotica virgifera
  unsure (1)..(510): unsure at all n locations
  Clone ID: pGUT3396
gaacttttattaaaataaaggtgtcctctaattttccttaaatacaggcattcttattaagatttattaaaagacaaaaataaaagacgcaatactgcgcatgcttatatgtcaaaataaaggatcttttattacaggtcgacttaaaagacgttggcaataactctctaatagctatctatttccagacttaatattctcttggggtgagttgtgtattctaattattttttcttgtaataacatttctacatctaacggctntttctaaaaaattttatatctaacctaacctcccatctaaaagcatggtttctgatattttagttttaaatatatctttttaatttacatataggcatgtgtagtaatcaaaattttaactatactcctgatcttaattccatntaatttatcccttgctatctgctactgtgtgaatacattttggcaaagggtaccttttcttcttgatgtcaaaacttatacatgcattactcttctagtttt

SEQ ID NO: 8824 - DNA, 222 bp, Diabrotica virgifera
  Clone ID: pGUT3397
attttcaacaaaaaatctctaatagttttcgatatattgaaaaaaatctattttcattttttaacttcaaagggctgtaactttttttatgagcacatttgtactaaggtaagttaagttcagtcgaactatttttgaccccagaatgtgtggtataatttatgacaaatcttttcgggacaccctgtatataaaaatctattgctgtgcgttagtctcgct

SEQ ID NO: 8825 - DNA, 657 bp, Diabrotica virgifera
  Clone ID: pGUT3401
gtcagctttggtattcctttcagtcatcgcactcagctgtgcccttacctttggtaccggcaagcaagtcaccatcaacgacgatggcactctcaccatcttgggagaaaatggtaagaaaatcgtcatctcaaacgccattggaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaaaaaagacagcaaaaactccaaagacaccaaagagtacaaaggaaaggaaggaaaatcgaaaactcaagctcaattacttcaagaaatcttcagcgaacaccaagaggcaaccgatgccaaatcctatggagaactcttaaccaaagtcgactactacgtaaaatctggtcagcttagcgctggtgttatgacgtcatccgcagcttaagagaactcaacaacggtgttactcagtatggaaaccaacaaccacttaaaaatcctggataccccgtagacaccacagtaccctcatactaccaatcacctgagcagtacccatacccttcatac

SEQ ID NO: 8826 - DNA, 147 bp, Diabrotica virgifera
  Clone ID: pGUT3406
cagctccaccagacgcagagtatgatttaatctccccgggttttaccctttatttttgttactccattctctctgttacctgatcagtacaatatttttgttaatgttgatttcaacacatttgtatatattgttcttattatcatt

SEQ ID NO: 8827 - DNA, 325 bp, Diabrotica virgifera
  Clone ID: pGUT3407
gttgattccaccatcaagacagctacaagtctatacgaaaaagtaaaggacttgaacggtctcacccattggactttctcgacagcagaaaccaccctctgcaaggcagtcgacttgggaatgcctattgccactcccgttatcaagaacttcgaaggacctattaagaaagtcgacaatgttctttgctcaggtttggattatgtagaagaaaagatccctgctgtaaaacttcccaccaacgagatttacaacaccaccaaagactacgtcaacaacacgataacacccgctgttgaaaccgccaaagcctacgcagagccag

SEQ ID NO: 8828 - DNA, 648 bp, Diabrotica virgifera
  unsure (1)..(648): unsure at all n locations
  Clone ID: pGUT3410
atggatgtatcacatttggaacgtccaagatcttaacgaactatctccagttcaacgtgtacagttgctcctcaactatgctagacttcaccagcaatggaaccaatatggttcagatgcatcagacaatgaatatatgcaacatgttttgtaccaacatcttcctggacaggcacaatcctactcccatgaccaaattgtaccatacgtcatgcaatacttcaaccaaaacccaatgaaatataacgacattatgcatgaagtaatgcaaaccccatgggcacaccaacaacttattcaccacgttatgtctgaattaaatcaacattacggtcaagccccatggtctcacgaacaaatccaaaaccaagttatgcagcaccaacttgtatacggatcttccaattcacaacagcaactccagcagttagtagaatttattcaccacatccaaaaccaacttactcctgtacattaccaacaacttgaacatgttcaacctttgaactctgaacaaacccttccatggcatcaaggacaagtatactcatggacccataaccaagttcttccattaaactacgaaaccgttcaacaaagatatcaacatgctcaaccacagctntaccaacaatctcaatcatacta

SEQ ID NO: 8829 - DNA, 557 bp, Diabrotica virgifera
  Clone ID: pGUT3422
cacccacctgcctcttgccagtttgaacatttcggttaagcgaaaatcaatgttgatttgtcaaataaaatttttttttgttttctgacagtagtaaaacgcattttgaattaaataaattacatacattcttctttctgtctcaattattttaattaaaaaatgtttttttgcacaccctgtgtaaataattatgttaatgtttacattagtgaatagagaattgaataccctctcacctgagttatcacatgacccatattttcatttaaaaaaaatcatcgattacgtcatcacgtccagatggatgacgtcactagtatgatatatatgccaacaaatcggaaattaaaaataaaaatcgacctgtttcgggatttttcgcgaaagttgtcggtttatgaaataatgaaattatgcgttactttttggacgcactgagttaattaaaaattaaattagtgattgattaattgagttgctacgtattcttacttataatataaccattacttaatacttttgcttatttaaccaatcacatcaaggtttttatt

SEQ ID NO: 8830 - DNA, 636 bp, Diabrotica virgifera
  Clone ID: pGUT3431
gatggactcattaatgaaaccatctacgatatcgtgagatactgggatcttgaacaccgtgtacaaggaattagtgacattgtccccacccaaggagtaaatactcttcgtcaatacgttggacaagtcggagatgttatgccccttggtgaaaatgtacaatctggaatctacagaaactggaacctagaccaagacttgctccaaaactattctccactcagacatttgcagaactcttcttggacaaatccaacagcaacgacaacttcaacaaggtttattgagccaacagcaatatttacctcaacaatatttatctggagaatatcgtcttgaagatcaaatgaacactaaccaaatcttgaaccaaatctacagacaacaacttggacaatctccattgaaccgttatttggtaaacatgagacttgtaaatggacaacaagtatacgaagttcctgaagaattcgttaacattcaacttctcgaacaacttaccgctcaacaagaaatgatcaaccaaagatgggctcaaatgatggaaagaagacaaccaatcactgaagacgttcactctcagcaacatctgattaaccaacagatcgaaaaacttattgaacaattagcttacca

SEQ ID NO: 8831 - DNA, 227 bp, Diabrotica virgifera
  Clone ID: pGUT3436
gtcaactccaaaagtctaattctaaacaaaatattggaaataggcttaattctgttttattttaaataaaacacttgatctctaaaaaaaaaaaaaaaaaaaaaaaaaaaataaaaaaataaaaaaaaaaaaaaaaaaaaaaaaaaaaaaaaaaaaataatgggggggggggggggccccccccccccccccccaaaggggggggaaaaaacaccccccgcccggcg

SEQ ID NO: 8832 - DNA, 349 bp, Diabrotica virgifera
  unsure (1)..(349): unsure at all n locations
  Clone ID: pGUT3438
gaaaaatctcatcgattgtggagtacagaataacaagatttcctctagctacaaactaataggtcatcgacaaggcagacaaactaagtgtccaggtgatgctctctatgaagaggttacgaagatgcctcattgggaggcgcatccaaattgagagtcagtgactaatttattagaataggtttagtgatatttacaaataataaactttttacattnnaaaaaaaaaaaaacaaaaaaaaaaaaaataaaaattaaaaaaaaaaaaaaaaaaaaaannttggggggggggggggggggcccccaaacccctttaagggggggggtaaaaaaaaacgggggggggttt

SEQ ID NO: 8833 - DNA, 114 bp, Diabrotica virgifera
  Clone ID: pGUT3439
ctcgtgccgcttggaatgaggtgaagatcttagcgcaaaatagaactcgaatgcgcgtttggctctatgatccacttaggagttcaagaaccttataataattacacaatttcc

SEQ ID NO: 8834 - DNA, 231 bp, Diabrotica virgifera
  Clone ID: pGUT3441
gcttaatgcgcttatttttgattttttaacaaaaaagaatatcaaacttgctccccagtttcaaaaagaactcaaaccggcatctttagtaaaaggatcaccagtacttgctgaaatagtgtcacattatttaaaatcaggtccaaaggcaaaacaattaaaagtgaatgcagaagacagtgacgaatccagcagcgaggaggaagaaacaccaaaaactaagccaattgt

SEQ ID NO: 8835 - DNA, 304 bp, Diabrotica virgifera
  Clone ID: pGUT3447
attcctttcagtcatcgcactcagctgtgcccttacctttggtaccggcaagcaagtcaccatcaacgacgatggcactctcaccatcttgggagaaaatggtaagaaaatcgtcatctcaaacgccattggaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccacc

SEQ ID NO: 8836 - DNA, 605 bp, Diabrotica virgifera
  unsure (1)..(605): unsure at all n locations
  Clone ID: pGUT3450
ttaagaggaagaacctcaccaagaagagcggtggtggaggtgcagctgaagaagaggaagactaagctgtatgtcgtgctagttgtactagtacttacatattaatatacttatgtattaaaaaaaaaaaaaaaaaaaaaaaaaaaaaaaagaaaaaagaaaaaaaaaaaaaaaaaaaaaataaaatttttaaaaaaaaaaaaaaataaaaaaaaaaaaataaaaaaataaagaaaaatgaaaaataaaaaaaaaaaaaaaagcctcttncgggcgccctcctcccatttttttaaaagaacaggggcggccgtcgagaacaaaatagatcggtccccctcttttttagaggtggttgagccaacaatcaaggtggagccggatgtataaagaaggagggatttattttttttttttttatgagtggggggctagtcttcctcctctctttaaaggggtgggggagagaaaccaccccgcacagcggtggggggttctttttttttttctcaataaaaaaaaaaaaaggggggggggggggggtgtgtcgtcccttactcaccacggtgggggggggggggggggaggaaaatttttctttttat

SEQ ID NO: 8837 - DNA, 435 bp, Diabrotica virgifera
  Clone ID: pGUT3456
gaactagtctcgaggtttttttttttttttttttcaaaaaaatttttttttaaaaaaatttaaagggcggggaaaaccattgggtttaaaaaaacccccggggaaaaccttgggggggggaattaaaaggggggggtggggctttccttgggggccccaacggataagggggcaattttcccaaatattttcccttttaaaaaaagctcccagggcagaaaaaagggcccttggggcccttccccggaccctaaaaaaaccggaagacctggtatggccattttggacatacccggggggacccgcttggaccaaaattttccaaggggggggtctttaaccaaaaagcctttgtgggaaaagggaaagggctgtaccccccccttttaaaacggattggggggggttcccccccccccctttaacggggggggg

SEQ ID NO: 8838 - DNA, 152 bp, Diabrotica virgifera
  Clone ID: pGUT3468
ggccgcccttaatgtcgtagtcttattaaagtcgcagatccattttggattttatactactactttaaactttttgttttgcatcccgcgtcgggattcgattgatgaacctacaatacatgagcacgtaaaggttggaataaattcatttt

SEQ ID NO: 8839 - DNA, 330 bp, Diabrotica virgifera
  unsure (1)..(330): unsure at all n locations
  Clone ID: pGUT347
tcgtgccgaatacggcacgaggagagtcgtggctatttatgtgacgggacggtgacgaattgacgaatgtcaaatcaatagcagaaacaaacaattttcgtttcagagttattgaatataggagtttacaaaaacttacaactataatgaggtatatatgataatgcattctgttaaggttcctcgtgtgtataaagtanctgctgaggtatctatagaaatgggcgaatgattangaactataaaaacacttgtatatgagaagataaaaaatcatcctaatatcaaagctatatatgcacttgtatcaacactctgtctgaaacttat

SEQ ID NO: 8840 - DNA, 157 bp, Diabrotica virgifera
  Clone ID: pGUT3470
tcagaccgcaaagtacttttagcttatttgtcagccatgtggggactcagatcatcacagtacccacacagattgaagttttagataagagataccataaattgtttatcttttgacttgtatagagaggaaagtgataaataaattatggatttat

SEQ ID NO: 8841 - DNA, 407 bp, Diabrotica virgifera
  unsure (1)..(407): unsure at all n locations
  Clone ID: pGUT3477
ctcgtgccgaannnnnnttttttttttttttttttttgtttggggggggaaaatttttttttttcccctttaaaaattttttttcaaaaaaaaccgtttgggatcccaagtttttgggggccccaaaaaaggggggtttttgggattaaacccttaaaaacccaattgcggaaggggggggcccattttttaaaaaaatttgtcttggattttttttcccaacccctttttggcacctttttccccgttttttccgttggaaagggttggggaaaaaaattttttgggccaaatgggaaaaatttgggccaaatttggccaaactttttcccaaatttgcacaagggggggggcccccccccaaattcccctttaatgggggggtttaaaaattttttggcgggttt

SEQ ID NO: 8842 - DNA, 489 bp, Diabrotica virgifera
  Clone ID: pGUT3481
ccatgcatgcgccaccctacattgccggaaaaagactttctatttccgttcttctgcagattcatataatctttgaacctattataaatatcctcatcaacttctgtgcagggttcttgtactatgggttcaggtactatttctggtacatcaactccttctggaatatattctttatccaatttataattcctatcttcaatacggttgatctttttcataaaaatgtcaataccgtgtttccaagtatgtctaccttggctgatgttaccatgtggaacactatctctatagattctccttaatccaacaattgggtatcttcttgttctactaccagatttattagtagcaaacccatatgcataaaaagcaccaacaacacagaaactacgatgattttctgtcggataataaaacattttcctattaatgtccaaacatattctccatacttcgaattctttgacatatacatcttggacaaaa

SEQ ID NO: 8843 - DNA, 153 bp, Diabrotica virgifera
  Clone ID: pGUT3482
gctctctctctctctctctctctctctctctctctctgtctctctctatatgaggggggggcggtcaccctacccatatctatctatagagagacatatatcgattaactctccgcccatgtagcaacaggaaggttggaataaatccatttt

SEQ ID NO: 8844 - DNA, 547 bp, Diabrotica virgifera
  Clone ID: pGUT3484
aagaaattacgtgggagaaaacacctcgacgacgtaaggaagttcaaaaagagactttggaagaagtaacccttaaaccattcagaaaatcatctgcaactagtcagacggttgaagaaacaactactgttactacacaaagaaaacctgataaagtacacactgaagaatcaagtctgttaaagctaactgcagctgaaagcattgaagaaactaaaaaacaagaaacgaagggttggcgttaaacctagagaagaaattaaaccagtggagaaacagctggttactgaagatgcaactatcttaagaatagatgaaaaccagaacgtagttaaggtgcaacaggctgaatctcgtggttggaggaaacctaaggaagcaaaaccaagccaacaatcagaagaagaaaagcccaaagtagatgagcaaaagcctgaaccagtgccctggaataaaaaagcaatccctctttaaaaaactcagattgcttgaaaagaacaaacccagggaaccttataacaagtgggctttaaaccaccaggaaaac

SEQ ID NO: 8845 - DNA, 159 bp, Diabrotica virgifera
  Clone ID: pGUT3503
ccaacattcataggcactgcctttaccaaccacatttcaaatacgctgaaatacaatgtatttatttttaaattattttattatatttaattaaaattataaaaactgtcctttattgttacgtaatattgtcattaataaatggtaagttcacagtgt

SEQ ID NO: 8846 - DNA, 588 bp, Diabrotica virgifera
  Clone ID: pGUT3506
gtcttgccgactgggaaattcaagcttaccaaatcagtgctgacactgacaacgaggctgtctttgactacaccacatcatggtcaaatggatttcaactctctatgaactacaatgcaaccattaaggaacttttcctttcacagcactactcaggaaccatcaagataaccatgaaacaaccagtatggactggaagaatcagcgcacaaaaaacccccactgacttaaaacctaacaccactgtagacagttttaccgtcgactggcacgttgcagatgtaaaatgcaaaatcactggtatgggattacttggagacacttatgctctcgctattcaagaaggtattgaaggtgccctcaaccatggtcttatcggaaataccgttggagacttccttaaaatgagattcaacactgtctggtatcccactggcaaagtctggcaaatgctggactattgcaactccctcgtgtccaccccagatgcacgacaagcctagtttgaatcaaataatcaggttaaataagaaggtattttcctttgtaacgataaaatacaattaaatggtaataattattatttac

SEQ ID NO: 8847 - DNA, 290 bp, Diabrotica virgifera
  Clone ID: pGUT3513
ccggaagtatgcagtcctctaggtctaggtgacttttagtaatttctcgttttataaaagaattgtagaataaaacgctagtgtataaggcgatagtttggtaattacattgggaagtatataaatttggcgatatgctaactattccttgaaggtagtatctatcgttttctcgatttttaaagataagtccactaccactgtttcctttacaaacggcaatggtaccattttgacgaccagcgcaaattttatcaaaaaaatgatattgttgctcaaatctttcggca

SEQ ID NO: 8848 - DNA, 555 bp, Diabrotica virgifera
  Clone ID: pGUT3514
accagacatacctcttccaccgttcttccttaaatttgctatctctttaaacttctgatagacatcttctcttatctcctcgtcatcctctacaatattgtctggatgaacagttttcggttctaggttggtggcacaatattcttgatcaaatttaagcttgtattctgccattctgtacacgtagtcatttataatgtctgacccatatcgcatttccattgttgcaacagggtttttgtctctacggctcttctttacatatgttctggacacatgaaattcatgttctagactacgtatcctaatagtcttccttcgataaatagggtctttctctccaacaatgtcgacgtccgtggacgtaaacattccatagaaggttgctgctaacgtatgttctctactctccattatataacgtctgccaaatagtttcgcaacccatctatcagattctctgcacaatacacgccaatctatttccctattatactccttctctttgatgctcttagttggctctactttgatttcatagatcttatcactatc

SEQ ID NO: 8849 - DNA, 507 bp, Diabrotica virgifera
  Clone ID: pGUT3521
ccaaaatcaatttttgattattttctttattaattctctttttttttgggtagttctggagaaaatatgggaaaatatgtaatatacattacacacatttttaaataacacagtacatggataatataatcactgatagtttctttactctagcataggcggttcagatggtataaaaagggtttttttaaatgtaacaccctgtaattaaaaaatttgcaattgcccttaaatcaaacctataccaaaagaatcagccagttatttgtgattaactggcgcagggcttcttcttaattttcattacagttagggcaaaataatttttttaaaaacatcttttttaaaaatttgtcatttttgtggcgccacctccgctaaacggtgggcgatagacatacgctctcgggaaataaatagtaggaaatatagtcgtcttcatgttactatttaagtaaattaccccctttaaagggatgaaaagggggggtccggggtgaatttttt

SEQ ID NO: 8850 - DNA, 205 bp, Diabrotica virgifera
  Clone ID: pGUT3522
caggtagactgtacattttacatactttattagtaaaatattttttattaattttagggtataccttgttggtacatatacgaattttttgtacatataagtaaaagctaaatatactattgattgggttgtataatatttcttttattacctagtggttgtcatatgtttctaggtttactaattttaatataaaaaaaattac

SEQ ID NO: 8851 - DNA, 605 bp, Diabrotica virgifera
  unsure (1)..(605): unsure at all n locations
  Clone ID: pGUT3524
ttgtcgtcttaacctgtgattcccggaaacaaaaaaaacaaacggtgcaaaatctgggctgtatgcaaataaatgtatttcgccttcaaatgctcgagatgttatacgagtcgtgtgagagctaacatagtatggtggcgggggtagttaccccctatgatggggttgattaagtcgaacactgttaccagatatatatttatttatcaacactaactataccagtaacgagttggtgggcaaagtctatattctaactacttgatgtctaaatatggaataaagaatgatctacaatactttctccgtatctataaataaactcgataattgtttttattatgattgccgacaccgaatcgaccgtgatattaataatatcaaaatagctgactagggcgttctcgaaacgagtgctctacattgtgacatcaatgtcacctagttattctactataaacaataatgtttgtgtaagacctttaaaaattaaattgatatgaattgttcttaattntttggatgctaatataaatcctgtacaatagtccttatgcanaggatacgactctatattctatagtatggaaaaaagtggagcattt

SEQ ID NO: 8852 - DNA, 269 bp, Diabrotica virgifera
  Clone ID: pGUT3531
agcaactggatattaccaaagacctatcacctgcttactgctaatcgatcaaaaaggaagcaccagctcaccaaaaattatagaaggtggatatctcgacacttttgctgtagtaaatatcacttccacaactgcgcaaccagttagttactatgcaatagtatttattgattagcctattttagtagtatttagctatatttatgcagaaatattatttatttaaatgatatatattttcgttaataaattaaaaaaataataatatt

SEQ ID NO: 8853 - DNA, 249 bp, Diabrotica virgifera
  Clone ID: pGUT3536
cagcaccactgtccattttacatactacattaatcaaaggggggttattaaaactggggggggccttcgtagaacatatacgaattttttgtacatataagttaaagctaaatatactattgatagggttggataatatttctttcattacctagcgggtgtcataagattataggcttactaattttaatataaaaaaaattacctcgtgccgaaatccgtacgagctcttgccgaattcgtctccag

SEQ ID NO: 8854 - DNA, 490 bp, Diabrotica virgifera
  Clone ID: pGUT3546
cacacttgacttcatatttgtaaacatatagcttaaaatgggttccaaagcttcttttgtttgcgtattgatgttgttggttgttgtagccaatgcgtatgatgcaacaaattgtccttcaaatacaggtcgccaaaaaaatcttgtttacgacagtcttttgacaggagtgtctatcaatgttcgtattccacaggcaggatattttaatagacccataacctgccttcaactaattgatcgacagggaacctctgtttctccaaggatagtggaaggcggatatctcgatacatacatggtagtcaatattacatcattaaatggccaagtactttactactatgcacaaatatatattgattaatttaatttttttagttgaataatatttatgtcaaacttagttttaacaaaataaaagcatatcctttaggataactaaaagttaaaaaaaaaaaaaaaaaaaaaaaaacttggggggggggcc

SEQ ID NO: 8855 - DNA, 560 bp, Diabrotica virgifera
  unsure (1)..(560): unsure at all n locations
  Clone ID: pGUT3549
tgtggccagatttcggaacaactcgtgccccattcacgccgctggtcctatattgagtcggatgacaattcactggccgccgttttacatatantgaggcggattacaatgcactggccgtcgttagagagggtcactgcggaggtgcacaagcttttgttacctacagtgaggagtatataatttgaagcccaaacgacacttaattttgctggaataaggtacctggaagagcgtcttatgacgcaaacagatgtctctgaagcctatgaattactagcatgctatacagaaaagtggatttacttatttttcaccgcgaataaatacggtgattaatttgataaattcaatacttactgccctgatgaatgctataatttggccctatggggggtcctggtccttaaaaaaccttataagatttttatttcaaaacactgaccgtcgtttacaaaataaggacaggttttttttttccaccctttattccagctttaataaaaaatctatgattatcttccttagccggggaaaaataccgggccattaaaaataaa

SEQ ID NO: 8856 - DNA, 426 bp, Diabrotica virgifera
  unsure (1)..(426): unsure at all n locations
  Clone ID: pGUT3561
ctaactcaagattcggcacgagttacaacgtctctgaggacaaccatctgtgaaggtgttctccaaaaagaaaaggaatatgggaaaagcaaaaattcaatgattgtgtgtggtgtcaataaataatgccaaacataattcatatgctatgatggtaccatttctaaatcccaagatatatgggcccgtttgattgttaacaagcccaaacaattctttattgcaaaacacgtatccgatcccaatgtccaaactgttgaagaaggtgattggagagatagtgccgttttgggagtcaaagatcaatgacagtggggatcattgcttggctttcantaccaccggattcctcgaaagtcaactcggcatccacaaaaataaacgtgttcctctcaatgaacaagaattggtagactgtgacacatc

SEQ ID NO: 8857 - DNA, 362 bp, Diabrotica virgifera
  Clone ID: pGUT3562
tctcagttagagatttccgagtttttggctcagctcgtcataatgtgtaattttggtttaacatttagccagctgttcagagcgaaagggggtagagtggtgaccctgataaacgaccgtaagatcgtttgtaagatcaacatagggagtagagaatttgaagcccaaacgacactaaattttgctggaattaggtacctcgaagagcgtctaaggacgcaaactgaggtctctgaggccgcggtgtcgcaagcaggcgtcacggcgaagtggataaacttatatttcaccggtaaagatttcggtgaaaaatatgaagatttcaataagttctgccgtgaggaaagcaagaagttggacga

SEQ ID NO: 8858 - DNA, 156 bp, Diabrotica virgifera
  Clone ID: pGUT3569
aattcacgaccaggtgctagctgttttttccagactcatctaaatgactgactaaaatgagatggtgtgagacaactacatttaagaaagtcctattgctctgagtatgaaaggaccaaatatataaaataatttctcgtgcccaattacgcacta

SEQ ID NO: 8859 - DNA, 236 bp, Diabrotica virgifera
  Clone ID: pGUT3576
ggaacttaagaaatcaaacaagttacaaaaacacatagaaaaacgatctaagaagttatccaaaaaagagaaaaggaatatgggaaaagcagaaattcaatgattgtgtttggtgtcaataaataatgccaaacataattaatatgttatgatgttacattttgaaatccaataaattaatgtattatattagatataccacacacattgatgttgaactattaaactattttatt

SEQ ID NO: 8860 - DNA, 348 bp, Diabrotica virgifera
  Clone ID: pGUT3581
gtctgataaggtaatttatctgaatactgatatagtgcgtttcttagaacttaagaggcccttctataaatatggtttgtgtataaaatgtgaattttaaatgacccatattatttcgtaattagcaattaagaaaatagtaaaataataattgaaacgtgtcgccacaggactatatcagacaaaagccctaagtaccaattttactgcgttgtttttatattgttgaaatactgataagtgtctgtacagaatattctctgtaattttattggctgcaaatcgaaatttttttataacacttcatttgtcaactatgaccgtttataatatacatggtagtatttt

SEQ ID NO: 8861 - DNA, 308 bp, Diabrotica virgifera
  Clone ID: pGUT3588
caagatcaaccaacgtgatggttgaaaagatactggccatcgtctcagggttggagtgcgaggttggtggctatggagagcaaagttaaaaccctagaggaggctcgccaacacatgttccaggctaccacaccgttgtaccctaatttggccaacatcgcccctacacaacatgtcccagtgaatgtaacacccttagctgcccaaaccgtctcggaggatccgtttggacccgtgtttaaaggtcattagtaattaagaaaaatcaaccaaccaacacaatgtctagatagatagcatgaacaagc

SEQ ID NO: 8862 - DNA, 201 bp, Diabrotica virgifera
  Clone ID: pGUT3593
ctaaaagtttcctgatgctatcatcccaattttaagagatatgtatgtagacgattttattatcagttttccaaatgtttctgaagctatagtaacacacactcagttagtgaatttgtttcaaaaaagtggttttaaattaaccaaatggatgtcgaactcgaacgatctactatcgacaatccccgaaccccttcaatt

SEQ ID NO: 8863 - DNA, 355 bp, Diabrotica virgifera
  Clone ID: pGUT3604
tacctggcatatcgtggagaagagttttggtgtgtcactactctcttaggtgtgttcgctcatttctgttcgttctttatgcatccatttgtgaacagtcgttcgcttgatgttatcagtacgtctggtttgtggtctgcacctacttctcttattttctcttgggcccaattcaacaattcgcttcgtccaacggttatcttccattcttcctatgtgacctgccataacttgcggcatcggctactgtattacgtgacataaaatagcgctgttgtcgataaacgataaaacttctgtatgtaccattatttaaaaaataggtattcaatcccttgttaacaatcccagtcta

SEQ ID NO: 8864 - DNA, 484 bp, Diabrotica virgifera
  Clone ID: pGUT3609
ttaaccaaaacctcaaaattaatccttggcttaagtaaaaatggggggctactttaaaagccattttttgaatacccttatcaaaaaatcatcatgacattttagaatttataattatttggaaccgttggtatcaaatcgaaatgtaaacaaattttgacgtttttgttttttacacaaataagttggatttttccagtttataaaaatattttttagacctttttttatattacattctaaaatttttggaaaacttgatgtactgtccctttttatatttatgcctgttactaccactttcgcattttttatttattttatattaccattattatgattcactaattacatctgttttaaaacatgtgttaagcaacattaaaatgggagcttagatataaacgtgcaaaggtttatacatattacatttattaagactagataaggttctcaaaacagctaaggacaggaattcatcaca

SEQ ID NO: 8865 - DNA, 302 bp, Diabrotica virgifera
  Clone ID: pGUT3610
ttattttattaaaaatagccccataattgatagaggggcaaatttaagcaaaatttgttatataaagtgattaaaataaatcaaaacttttaagttattaaagatcaaagattttaattttttttgagaaaaatgcatgtttttaaccaatttttcatcaataactcaaaaagtgtaagttcttacaaaaaaggtattatcatcaaaattgaagccaataaaaaataaaataaaccttttagtagaaaaaccttttaatattaactaaaagtgagttataggtaactgaatatatatttttt

SEQ ID NO: 8866 - DNA, 134 bp, Diabrotica virgifera
  unsure (1)..(134): unsure at all n locations
  Clone ID: pGUT3614
ttangtgttaatgataaatttagtttttatttgatacattggtacattcgttaagttaaaattaagttaattggtcaattgttataatacacgtatttttttcttatggcaccagctgaagaaaacgaaagaga

SEQ ID NO: 8867 - DNA, 425 bp, Diabrotica virgifera
  unsure (1)..(425): unsure at all n locations
  Clone ID: pGUT3615
ccgaagtcgacgagaactaaaattcatacgttaattttggatctgaaatcaaagctttataactnttatatttgtctcctctccttttattttttatttaagcatgttttttgtacagtctctacattcccgtttgtaaatttcgaatacactacttaaattattccaagactgactttttgttgcttgtgtttctggaatttcaggaagtgtttagatatttaacatgttttgcgaactgtttttttatgaataggcattaaaactgctgccattacttatacacnnnanaaaaannaaaaaagaagaaatttnntntnncnnnnnnnanaaanaaaaaaaaaaaaannnnnnnaaaaaggggggggggggcgcccccccccccccccccctgggggggggtttaaaacccccccccggggggt

SEQ ID NO: 8868 - DNA, 388 bp, Diabrotica virgifera
  Clone ID: pGUT3619
ggatgatcaaattgaaggaattataaatctagaactcccataaatttgatgatcaactcatactggtttgaacaaactgacaccagcttcgatgggcttcgaaaattcttggaaaacacagttgcacgtgaagcaaaagataccttcttcgtctcacagaaacaggtcctagattttataaaaaatcccgttaaaattagcgattttaaaactgctgacgcgcccgatggagccagttgtgagccttacacctgcagacttaaaaaaggaacagaggatagaaacatggacgcgtgtgttccttgtccagacgaatacccatggattaataacgttaatgtataaataatcgtattttgaatctaaataaataaaagtttgatagatt

SEQ ID NO: 8869 - DNA, 318 bp, Diabrotica virgifera
  unsure (1)..(318): unsure at all n locations
  Clone ID: pGUT362
tatttgcgtacacgttggcgtgtacctagacacagcgaaatataaccataatcaaaactaatgcaaaactatgtgacgtcacgggccgtttgaactattttataccgtagaagactttaaatatgtatttctaagttattacgagtttttgaagagtgaaattttggaaatctcatttttaaacaaaactgtacattattatctaataaaaaaaatgtgcaagttcnctattggccaatataattaaaagtgcgagaaatgttgctgatctatgaaaccaggtgtcgcgtcgcttttccgaacttgcacggtcccaat

SEQ ID NO: 8870 - DNA, 470 bp, Diabrotica virgifera
  unsure (1)..(470): unsure at all n locations
  Clone ID: pGUT3620
cagtcgcatcagaggtctttggcattctacgttgaatctctaactagtgataagtttgtgagttacaaatgtgacgactatgacagttacaaaaatggaacgtgcaaacttcaagatgataataagtccataatgggccagtttactaccaaaatagatacaaaggcaagcggtacctatttcctggacacgaatgataaacctccctatgccaagggttaaaatctgaaagtgtttttatatttattacttagacctaggtagatgatcatgaaattataagggtttgtcttatattatatgttaaatatagttaattgacaattgtatttacaataatacaatcaaagaaataaagttaaatttcgaaaannaaaannaaaaanaaaaaaaagaaaaaattaaaaaaaaaaaaaatgggggggggggggggggcccccacccccccattaggggggggtttaaaaatt

SEQ ID NO: 8871 - DNA, 483 bp, Diabrotica virgifera
  unsure (1)..(483): unsure at all n locations
  Clone ID: pGUT3625
ctaaaaaggataaattattaccacactaatagattgttaactaattttaaactacaagttaatataattaacaatatcaaaatggcgatgataatgcctgaactgtacgcaaaattatcaaccaacaatgtaaacattacaaaaactcttctaaagaaatacaaacatttattaaatttcaaaaagaatccatcaatcctggaattcggcttcgctagtggcgagaattcaaaacagactctacagccttatcttcctcatgattataaggagtttgtagctgtcgatatctcagaacctatggtagaacgagcccggaaaaacaacacgcatattccaagaagcaaattntattgcttagatacatcagcaccagacttaccagaaatgttccanaatcgatttgataatgtatttagtattatgacaattcatttagtaaataatccaagacagacattcgccaacacatttaagatgctc

SEQ ID NO: 8872 - DNA, 429 bp, Diabrotica virgifera
  unsure (1)..(429): unsure at all n locations
  Clone ID: pGUT3627
tttagctttgacgggttctgtcaaatgtacctaaacaacatattctttccaactgctttcacggttcttagacatttgctacggttgcctactccgactgtggtggggaggctttttgtggccaaatgtttgacttacgtcacaagagtacaaaagcctatatttaaatttgttgcggtaacgatcttcgatctttgaatgtgtactattatctatgtatttggattatgtatttgtgtaattatttatcttatcttanagatagcacgagatagataaccaaaaggtcgaaggagtatagaaaggccaaggaagaggtggagtgacaacctggatatctgatgaggaggcatncgaagatggaacaggcgcgagcctattaggggagcaggaagaagaagaatangattattcatctaatatatcata

SEQ ID NO: 8873 - DNA, 122 bp, Diabrotica virgifera
  unsure (1)..(122): unsure at all n locations
  Clone ID: pGUT3632
aattaaaaaaattggtaaacttcncannaaaaaaaaaaaaaaaaaaaanntcccctgggtggggggcccggccccaaattcccctttaggggggggttttaaaaattccggggccggttttt

SEQ ID NO: 8874 - DNA, 127 bp, Diabrotica virgifera
  unsure (1)..(127): unsure at all n locations
  Clone ID: pGUT3634
gcatcttaaggtataaattgatagggagatacatacgcaggatatactcagaaaaatctgtgaacacgcatacactctatggtaaacgacctagagatatnnnaaaaaaaaaaaaaaanaacctggg

SEQ ID NO: 8875 - DNA, 131 bp, Diabrotica virgifera
  Clone ID: pGUT3636
cgaaaaagattataatacccatgttcgtccgtctaaagatctggtctactggcaaggatcgatcccaccgtaaaccgataatctcaacggaaataagggctcgtgcgacagtcgtagcgaaccggcacgag

SEQ ID NO: 8876 - DNA, 393 bp, Diabrotica virgifera
  Clone ID: pGUT364
ctcttggactataacttgttcaactgttttcacgaaatattttatagtcactgcagttgcgaaacgaggagatctgaaaaatttgtgtaatttttgtttgaattgtacttcattatcatcttagtagatattataaatattgatccatccatgctatggctctacagtccaataattcgagccatggcctccttcagcaaactttttcattcgttatggtcattctcctccacgatcgactgccaaggatatttctcgagccctcatccgcatcatcctcacatcgctttctcggtcttccaatagacgtcttcgtgtcttcacctgcattcttgcattcgaacatttattggaaacttgttttctgccaccctaaatacatgctggtccaat

SEQ ID NO: 8877 - DNA, 373 bp, Diabrotica virgifera
  unsure (1)..(373): unsure at all n locations
  Clone ID: pGUT3642
ccaaattctacgccactggcgaaaatgctattttagttaattttttggattctccagtactttctatgaaaataatatacccttcattcgtaacgataaagtgattagttttcgagatctttgaagttaaaaatgaaacgacacggntattttgattaatgtattgtgtcgcttaatttttaatttcaaatatctcgaaaactaaccattttatcgttacgaatgaagagtatattatttacataaaaagtattgcaaaataaaaaaattacacgaaaatagcaatttcgtcagtggcatagaatttgggaagggtcaaccagccactatcccctgtcgtacgcctctggtagtagctagaaacgtttattta

SEQ ID NO: 8878 - DNA, 678 bp, Diabrotica virgifera
  unsure (1)..(678): unsure at all n locations
  Clone ID: pGUT3646
aaaaggcacgtctgtgattacagacatttataatatttattctagttgtcgatagatttcgctataatcgaaaaaaatttatttgtgtaccaagtcagtaaaatgactctttatcgaacgagtctgatattacgagaagagtgagcgtggcgagcgaggcgagtaatagacgagttcgataaagagtctttactgacgtggtgcatacaaaatttaacgccaacattatttgattggaaaaaaacttggaatttgacttccgatgattcgcaccttaaagttgactacgtaagagtttgggctctgtaatgatttaaaaaataatataaaatttataaaaaaattaataaaaatcggtcggttatttaacttctttaaaatctcattataacaccacaccattttttaaattttagtatcttcattatttcataaaattaatcatatttaattntaataatccccgaatgaaaaactgaagaatgaagtggtgaaaacttgacagcttggacaatgccaaaatatattttatctaaaatttcactttctataataatttgatattgttgtaacacttacttgcatttacaantaattaagaactnntataaatntagatgtcataataaattcatgacattgatgacagtcaactntcgattttaatcgataagtagt

SEQ ID NO: 8879 - DNA, 236 bp, Diabrotica virgifera
  Clone ID: pGUT3648
aaacccgttaggtaaaagtcataacgatgacaatcacaattactacaattccagcgcaccaaacgataacaggaattcgaggtattatgatatggctcctaagtttaatagacaacatgaagcttcgacgcgattctaaacaaagttactttttttaagtgaaaaaagtgaagataacattggaacaaataccgaaacgtagtattatcaatatgaaagtatgaaattatacgtaa

SEQ ID NO: 8880 - DNA, 478 bp, Diabrotica virgifera
  Clone ID: pGUT3652
atgacgtcgcctatatttagaatacctttttgtagtaacgtaacaatgaggttttaaagaaaacggataaatatatttaaatattttttaagtaggttaaaagtactgaacaacactcgagtataaataaaaattcgaaaattataatatttgagacatttgggacatccagagaggtataaccttctagacctcataatacaaggtacgattgccgaaagaagtggcccacgcagaagaagaactccagactccgcaatctctaagaatggcatcaaaagacatccgctaatctgtttctagctgccgcaaacaaagttattattgccaatacgatcgccaacgttcgataatgggacagtgtactgaaagaagaagaacacgagtgtttatcaacgcaaacctttataatggaactttgaacaagctctatcaagcaattggacgaaaacatcaagggaaactcttaacatagtat

SEQ ID NO: 8881 - DNA, 174 bp, Diabrotica virgifera
  Clone ID: pGUT3657
cccccaaattttttttttaaaaaaaaaaaatttcccaaattttggggtaccaaaaccccggggtttttttttttttaaaaaggggcctttttttttttcccccaatttttttttagggggggggggcccgccccccccttccccctttgggggggggttaacaattccgggggg

SEQ ID NO: 8882 - DNA, 62 bp, Diabrotica virgifera
  Clone ID: pGUT3659
cttatagcgtagaagaactgggggttcaccctggttttcttggtttgcattgtcgcaccagc

SEQ ID NO: 8883 - DNA, 296 bp, Diabrotica virgifera
  Clone ID: pGUT3662
caaaaatcgtcctcttcttctgcgccatcattttggcttcagcagctgctttaccaacccaatcagctgacggaggtgttgtcgacatcatcaaaaaggtcgtgcacaagcttgaagacataatggaaaaagtttttactgaaagtcccaatttcatcgacactttccctgacaagtatgacgaccaccttgctaaagtgctagatgttacaaggaccgtgcttactaaaatcgctcaagcacttaaaagttgttatagataaagttgctgaacaaagtgatgatgctggaaagaa

SEQ ID NO: 8884 - DNA, 511 bp, Diabrotica virgifera
  unsure (1)..(511): unsure at all n locations
  Clone ID: pGUT3674
gacgaagttttttntnnntggcttctttttctttacaatccgaaaaattgaaaaaaannaaaaacggcaaaaaattttaaacccttaatggttttttcattttaaagaccccttttgaaaaagggggcggggaaaaattttcccccatggggtgaccaaggggggccctttttgagaaatttccttgggaaaaaaaaaaaatcccccgttttgggcccaattttttttcttggtgaaaaaaaaccaaattttcccatttggttaaaaaaaaaaaaaaaaattttggggaaacccaaattttttggggcccccaagcccccctaaaacggaaggggtgtccctttgggcaaaaaatttcccaaaaaatttgcctccggcccaggggggaatttcttataactgggggtttttttacctggggggatgggggaaacccataaaaactgtttaaaagaaattaaatccgggggcccatttaaagggggggggggcttattttggggggggggaa

SEQ ID NO: 8885 - DNA, 443 bp, Diabrotica virgifera
  unsure (1)..(443): unsure at all n locations
  Clone ID: pGUT3676
actggtcaagaagctttcgaagacgctgatgaagttgttggaggacatagtgggcgtatcgctaaagtagttaaaaccgctcataccagtggtggctacggatctggtggacaggaacaactcggtcaaataaaatcatatctgaggagagaaccactacaaacaggacaacaagcttttgacgaagaagatttaggtgaatcagtgcattctggaagttcttctcgcatcgttaaaactaccgtcaccaaacacaccagctcatatggcagaaacgataaccagctntagatgtaatacagaaaatcaaaaatattatttgtgaataaattataaaaaatagcccnnnnnanaaannnnnnnnnaannnnnnnaaaaaanaaaaaaaaaaaaaaaaaaaaaaaaggggggggggggcccccccccccccccccctttggggg

SEQ ID NO: 8886 - DNA, 321 bp, Diabrotica virgifera
  unsure (1)..(321): unsure at all n locations
  Clone ID: pGUT3690
gttaaagagattgttgaatgccaacaaatacagaacagaccttaccaaggctgcccttcgcagagctagtgcagttctaagatcacaaaaacctttaccagccaagaaacagaaggttgcccctaaaaaagaataggtgtattttttaatgtaataaacaaatttataaaanagaagaanaaanaaataaaaaaaaaaaaaaaataacccccccnnaaaaaaaaaaaaaaaaaaaaaaaaaaaaaaaaaaaaaaaannnntttgggggggggggggcgccccccccccccccccctaaggggggggtttaaacaccccccc

SEQ ID NO: 8887 - DNA, 580 bp, Diabrotica virgifera
  unsure (1)..(580): unsure at all n locations
  Clone ID: pGUT3692
tctagacgtcataaacgtaggtaccgagctacgatttagaatttcaagtcggttcccgagagacactgcagcagagccgcaccccggggattgatatatgtactcccccacactatatggtgggagttgaaatcgcaccccactaggagcgtaattcgcaggtcctcacagtatctgaccaactccatcagttccagtgttggagggggttctggtgaatatttcaatcacttcctcggtgttttggaatttggtgttctgccaattgcttgtttatgtagttctttacagaagtctatctgtcaaaaatcattgatttcacataaaaatcttatacagatatttgaaggttctaaaacgtaaatgaggaaaaattcgtgaagacgtacagctgattttgctttgttttttaacaatcttaaaaattaagaaaaatatatttttttgcctataaacaggtcgaccataagttatttaatttgtttctcctgagagcgattntaagcaactgtacttgcccaaacagtcactctagactttgtattttgtagtcactattttgtatatcgcaatcgattcg

SEQ ID NO: 8888 - DNA, 586 bp, Diabrotica virgifera
  unsure (1)..(586): unsure at all n locations
  Clone ID: pGUT3696
agtagctntaaagtaaccaaaaaagttatattttacaatgaaaggtctagttatctttgccttttgcattgccgtggttgtatcccttccattggatgtcattgaagatgagagtggacaggaatatcttgtagttccagtacacagagaaagaagagacttaacctggggtgccaaccaaaatgggtacactcttggtcaaaaaggaaatctctgggaaaatggtgcccacaaatttgacggtgcttacactggttcgaaagcttgggattcacatggactgaaacccgattcttttgggggtcgtttagaatacactaataagccaacaaaaactactgcctttgtaggcgcagacaggactcctggatatggtactgatgtcaatgctggagttaaatataactttgttcaagataaaaaactttacattgatttgacaggacaactaagtcagcaccacggtggaccctttggaaatacannaacctgagcaggagtatatttaaattntaatgctagaccttaattcacaacgataaaaaagactgtactaaaaatattanntaataaatattattttttt

SEQ ID NO: 8889 - DNA, 600 bp, Diabrotica virgifera
  Clone ID: pGUT3699
caaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcccaatttcatcgacactttccctgacaagtatgacgaccaccttgctaaagtgctagatgttacaaggaccgtgcttactaaaatcgctcaagcacttaaagttgttatagataaagttgctgaacaaagtgatgatgctggaaagaaattggtttcctgtgtcgaacaacacgaagcagatctcgtcaatatccgcgtcgctttcgtagaaggtgccggcaaatgcgtgaaagatagcgtcatcgctttggttaacactggcgcacctttgctcgaagatctaactgaaatccataagcaagcaagagacgccgccgaagaaattgacaattgtgaaggagataatgcagctggtttgctctgcgtttttcaggtcgccatggatattcttaaagttgaccttcagattcccgaagctgtgaaaggtgatatccaacccgtcattgatgccg

SEQ ID NO: 8890 - DNA, 581 bp, Diabrotica virgifera
  Clone ID: pGUT3700
gtcatatcccgccatggtaattgaaagacactactagcagaagaatgacactaaccaacaccagatttaaactccctatgagaatacttggcatatcattcctccggattatattcatctggaagaggaataccgatatccattattggataccatgaaaatgaccggaacaaccatagccaaccaaagacaacctgccagttttgcaattagtgatattttagaattagatagacaaaatagtgaagaaatagatccaataaccacagatatgtcagtttaccccacacaccacgacctttcctattcaactagacatcagtggcttcaagtacctgaacctggaatgcatcacgcaccacctcacctaaccattccaccccattcgtcacaactaagcccagacagcaccagtcccgcaatatcagagagatccagcgtccccccagacacgcctttgggagactccaacatgacaaacccccttaaccaagctccttcctcaatgggaacgatcagcgaaggagaaatggaagaacaagatgacattaaagaagaggaaggagaacaacagtcgaatg

SEQ ID NO: 8891 - DNA, 170 bp, Diabrotica virgifera
  Clone ID: pGUT3706
aaacgaattcaaaaaataaattttttcactttgaacaaatttggtttaaaatctctggattcagcttgggcaaaaaagtatcttgtgaatttttctataaaattgactgttgtcgagttacatgcaatttcaaatttgaacaacgcgaaaatagccattttcaaggctta

SEQ ID NO: 8892 - DNA, 370 bp, Diabrotica virgifera
  unsure (1)..(370): unsure at all n locations
  Clone ID: pGUT3713
ctattcttcaacaccctcaaaaccacttcataagacgaaactatccatacgtgaccgtattttatgaagattgacttgcgttctaagtttctgttatgttaagaaaatatgtttgccatttacttacattatggttcacttttgtagtgatttggatgaactatgttaaggaagtcttaaatcaataaaaaaatgatcattttgtaattcacctggagataaaatatatcttcataattagtattagtaacgtaagagaaattagtttagttaatagtgtttatacattttcgtcatgtattatattattaataaatattattattcncnananaaaannnnnnnnnaaaaaaaaaaacccggggggggg

SEQ ID NO: 8893 - DNA, 152 bp, Diabrotica virgifera
  Clone ID: pGUT3714
aatgatactaaatcaactacactgcgcgccattaaaaagaggccacctaaatgttttgtcatttttaatttttacgaatcctaattgcttgctattagatgtttgtacaatgtttaaaaatatgttttaaagcagtatatgtcttgaataat

SEQ ID NO: 8894 - DNA, 614 bp, Diabrotica virgifera
  unsure (1)..(614): unsure at all n locations
  Clone ID: pGUT3716
gaaagggccaagtcagctgttgaaccaaccctggagagggccagacatattgtagaaccaattgtacagcctgctttggacaaagctaatgccatcaaagaaaatgttatgcagagggttgatgagtacttgcacctctcccaccaagaaggtgaagtagtcgaatgccaagaatgcgtacaaatcaggaaaagattagaagcacaacaacagcaggacaaccagaacgaacagcagcaacaagatcaacatcccgaggggcaataataaagcgcgttttgtattagtttatagtggtttctatgtttaacgtcccaattgtattttaagactgtttttagattttaatctaagggtggcttccagaacattagtctgaacatgtgccttttccaaaaagttttcagaattagaaaaatttaaaaatattacggtgttttcaaaaagaaatactctattatttaataatacatttattacttttgtaattntccttctttctgtattcagtattcaaataagagttttctttaatttgaatactggaaagatggtaaagttattggtattttaacgttaatatctatataataagntgatggtacatatctagc

SEQ ID NO: 8895 - DNA, 197 bp, Diabrotica virgifera
  Clone ID: pGUT3720
atagagaactgatgatattgagtgggaaatctctttctaatagactgagtttattcaatgacgttgggttaaaattaatttgtattagctttaatagtttggcgtttgtattagtattaattattattatcaacatgattgtatctggctaaatagctaatttctaaagccatacatgatagaatcagactaaatac

SEQ ID NO: 8896 - DNA, 449 bp, Diabrotica virgifera
  Clone ID: pGUT3724
accaggacattgttaccaaccaaatcttagacctcatctacaaacaacaacttggacaaggtagtgcttacccactaaatcaatacttggttagccaaagacaagttaatggacaacaaagattcaccgttcctgaacaattcgttaaccaagaagtgttaaatcaagtatacaacgaacaatccttaattaaccagagagcacaacaacttgtagaacagaaccaaccaatttctcaagaaatttatgtccaacagtatggtttgaacaaacaagtagatcaacttatccaatcattggtatatcaccaaaatgtgatctctcaacaagttgaacaattcattcaacaaggacaacgtcttccccaagacttgctttcccaacaagtattagtctaccaacaagttcgccaattgattaaagttttgagcacccaacaacttaacatg

SEQ ID NO: 8897 - DNA, 556 bp, Diabrotica virgifera
  Clone ID: pGUT3726
ctagtctcgaagttttttttttttttttttttaaaaaatgggccaaaataaaaaaatttttttatattttgggcctttccgcccaaaaattttttaaaaattaaaggatgaaacccccccgggttaacccgggttaaaaccaaaatattgaaaaattttaaaagccgaacaacttaaataatttgggggttaccccaattataaattttattccaccttggggggggaaattttttttatgaattggaactcccaaaaaaaataaccctgtttccccaaggggattttttttttaaaataaaaaaattgggttaaaaaaattttttttttttttattattttaaaaaaggttaatttttttttttattccccccattaaaaaaaattttttataaaaaaaattttaacccaaaaaaacctttttaatatttttttaaaacttttaggggctttctggtttttaaaaaaaaattaaagcttttaaactaaaaaaaaaaattttttaaaaataaaaaaaaagaggtttttttttatataaacctttatattcagtttt

SEQ ID NO: 8898 - DNA, 581 bp, Diabrotica virgifera
  Clone ID: pGUT3729
aaataacaatacgttgatgtagactacaacagctacaacgctcatcccgtcaacaacttctggaggacttggaatcagcaacactatggacaagaaccatggaaccaatgggtacaatatggtgtccagaaccaacccggtaactactggaggcagtacgtgcaacgcagcaaccaagctgaaaatgtcgatttaccttggatgtatcactcttgggatgtccaggatatgcaaaacttaactcccgttcaacgtgttcagttgctactcaactacgtcagacttcaccaacaatggaaccaatggacacatgatgtaactgccaatgaacgtcttcagaatatgttgtatcaacaccttcctgaacacttatggagctccaacgagcaaattgtaccatacatgatgaactacttcaaccaatacccaatgaaatacaacgacattatgcatgaagttatgcaaaccccatgggctcaccaacaactgatgttccacgttatgtattgaatataccaacacttcggtcaagccccatggtcccacgaacaaatcatgaaccagatcatgcaacaccaata

SEQ ID NO: 8899 - DNA, 291 bp, Diabrotica virgifera
  Clone ID: pGUT3731
gcagctgatgaaaccccaacgacagaagaaccaacagtggagggtaacaccgaatctgaaaaggtagaagcggaggtggtggtagaagctaaacaagaagaggagtcctcagttcctagccctacagacgagattgtggaagaaatttcgagtcccaaggaggagatttcaagtcctaagaaggagattgctagtccagataaggaaattccagatagtgatttatctgaaaggtatctcactcccaccgaagaaatttcagaaaaaaaaaaaaaaaaaactcgggggggg

SEQ ID NO: 8900 - DNA, 467 bp, Diabrotica virgifera
  Clone ID: pGUT3734
tttttttttttttttttttttttttaaacaaaaaatttttttttaaaaaaagggcccgctttttttttgattagggggccccccttaaaattaaaaatccccccggcttgggggttgtgtttcaaaaagggcccccctggggggaaactaactggccgcggaaaacattaggaaggtttttattctggaaaaaagggtgtttaacccccgccttggagaacagccccacccccgggggtttggttggccccaaaaaaaacaaaaatttgggggggcttatagggggttcccccccccccccaaaaaaaattgggttttaccccggggaaaccccagcttttgaacccctggaagccccccgaaatttgggggcccccttttcccaaaatttttttttttgggccaaaatggtttccttttgggggggccccccgaggaagggtttttttttccttggggggggggcc

SEQ ID NO: 8901 - DNA, 486 bp, Diabrotica virgifera
  unsure (1)..(486): unsure at all n locations
  Clone ID: pGUT3739
gtattgatcaagcaattcatctaccaacaagctagccttagacaattagttcaagtttttgttcaacaaggtcgtgttgttccccaacaacttgtttccagctacttcctgatctacaaacaattggtccaattggttcagcaaggagatcttgttcctcaagaattaatcgctcaacaacaactgatccatcagcaagttgtactattactccaaagaggagttttgccccaacaatcagcacttaaccaattggtctctcaagaacaacagttgagcttgagacagccacaaatctaccaaagagtaccacgtgtgtactaaattttggtttctttttattattgatttttgagttttcatgttaattttgattgttgttttcgaataaatgattatctgttaaaaaaaaaaaaaanaaanaaaaaaaaaaaaaaaaaaaaaactggggggggggcgccggccccaatccccccttaagggggg

SEQ ID NO: 8902 - DNA, 161 bp, Diabrotica virgifera
  Clone ID: pGUT3742
ggcaaagtctggcaaatgatggactggtgcaacggcggctccaccgacgccccaacaacagctgcaccatacacaaatgcaccctcaacagctgcaccatagacagatgcaccctcaacagctgcaccatacacttatgcagcaccagcccttttttaagc

SEQ ID NO: 8903 - DNA, 392 bp, Diabrotica virgifera
  Clone ID: pGUT3746
ggcacgttaacatgttaaaaaactatatattattaaaatgctggtgcaatctccacatatataataatcacccaccaaattggcaaagatcaccttcgttcttttggctgaacaaccagtggcggccttggcaacagctgaggccagccccaaggcagctcatggagtaagggtctttaaagcactgcctcttgtaaaaattccagcatcatgtaatggcaatacctgctcacaaaaatgggaaagcattggctcaaactatactggaggcattggttaccaatacgactgttattgtgcatacgttcattaaatatgttgaaattgcgccagcattctagtaatatatagttttttaacatgtgagggagacaaaaaaaaacttggggggg

SEQ ID NO: 8904 - DNA, 664 bp, Diabrotica virgifera
  unsure (1)..(664): unsure at all n locations
  Clone ID: pGUT3747
gtcatttaaaaaaattaccatgggtactatcaaaaaatgtgatagttgtatttttaactgtacaaatattcattgtaagatgtagcgacattacaaaacttgcttttggacaatttactcatggacttccagcagcatttggagactttaactctgatgaacttacggatgtgtttgtgttaactaatagggaacaaacactccaaattcttttagcttatgcagaagagccattgcttcgaccagcacctacacttaattgcacatttaaaaaccacaagattaccagtgttgtaccaggtgattttgatggagatgccttgatggatgtgttaataactactattaaagcagatacctcgattaacaatgcaaggacaagtatttatattctatggggaggtaatactaccttcaattgtacagagattgaagggccccattgattgaaatngtangtcaaccatggcaattgattataatcaagatatgatcattgatttgtttggagaagacatttgagaaaaaaagagccttttggtttttggtaaaaacagaactgagcctaaagaaagtggagatgcatcaccacaataaagaaccaaatggcgtactcatgaagcctcatgctcatgcatttttagatcttaatgatgactatatg

SEQ ID NO: 8905 - DNA, 551 bp, Diabrotica virgifera
  Clone ID: pGUT3751
gttgctaccaatggtcgggagtcgggatcgtgtcattcatcatctgattttcttttgagaattttttgaggttgtgtttgggagttgggttgttttgatggcggtcacgaacagtcggaaacgtatccgctctcatcggatgcgcgcggaggaacgagttttgggcgactttgcgcagattcgccaaattggaacattgaaaacaatgcatttttcgatgatgttgatatcatagctagaagcaaaagagaaatgatagaagcatttaatgctatataaagagcggcacacaacagtggcctaaatattaatgaaataaaaaccacatacatgaaagcccgcaaatctacaggccaaagaaacctacagaatctgacaataggagactataacatcgaaagcgtaaaaaattttacatatctaggttcactagttaccgcagaatacaatgtcagcgaagaagttaagagaagaatacatattgctaataaaacatataatggactcattaaacatctaagatctaacaacatcacgagaaaaaccaaatg

SEQ ID NO: 8906 - DNA, 222 bp, Diabrotica virgifera
  Clone ID: pGUT3752
agagtcgcattacacttcactggccgtcgtttacacagacagctgctgacaaagctgcattcatgggtcctctcaagaaagatagagttaaggaagaagagaatgctgctgctcctgccgcagctgcatccagttaaagtgttaatgtttgtattgtttgacaataaacagatatatagcttctcaaacgaataatttgaatgaatatctttgggggggggc

SEQ ID NO: 8907 - DNA, 446 bp, Diabrotica virgifera
  unsure (1)..(446): unsure at all n locations
  Clone ID: pGUT3756
atattatcagcagaacttccaactccagcaccaagtccaacaccagaaccagatgacttagtctgtggagtttgttttatgattgggaatatcatggaagctttcaagaaagaagatattcctaaggaaacagcaacatcgcaaaagacttttgtttgtgaagtagtgtttgcaactgaagaaacaaggcaactatgcttggactcatatctagaggaggttgattccttttatgacgaagttgacactgacacagtaatggacaaatgcatccaattgaaaaagtgtccagctagtggaagttattaacgctattatttttctaaataaaaatatattgttattctaaataaaaagtgctgatgctaataaaacataaatgcattntataacacaaaataaaacaatctggaacacaaaanaaaaaaaaaaaaacctcgaggggg

SEQ ID NO: 8908 - DNA, 641 bp, Diabrotica virgifera
  unsure (1)..(641): unsure at all n locations
  Clone ID: pGUT3763
ctagtctcgagnnnnnnnnnnnntnnnttnttttttcttgggtttgtcttttttttttttctccccccccccttcccggnnccgggggggggggggcccccctttttttttaaacccggggggggggaaaaaaaaaaccccccccttttttttttttcccccgggggttttagagggggaaaaaaaaaacccccccccctttttttttggggatctaaaccccccccccacattcttttttttggggggggcccccccaatgggaaaaagggggggggcccttcttaaaaacccccccatttttctttgggggggcgcccggggggggaaaaaacaaaatttttttttttgccggaaaaaacaaggggccccccccccccctcctttnaaccccaaaaaaaaaaaaaaaaaaacggggggaaaaaaaaggggtttttaaaaaaaaaaaaaatattgtgggggggggtgtttttggcgcccgggggggggggaaaaaaaaaaaacccccccccctaacacaaaaattttttttatttttttatggcccccccctgtggttgaaaaaaaaaaaaaattttttttcaaaaaaaaaaaaaaaaaaaaaagggggggcggcccgcccccccccccccccggggggg

SEQ ID NO: 8909 - DNA, 220 bp, Diabrotica virgifera
  Clone ID: pGUT3767
cacaatctcattatagctacaatctccaccaacaacaaattccacagtccatggaacaacctggatggtggaaccaacaaaatggatggtggaaccaacaatacaaccagaatatgattccacaaggacatcaatatgctgctgtgggtcatcatatggctttagtgcattaaaaattaaaacgttataactcaaaatataaataaaataatacattttc

SEQ ID NO: 8910 - DNA, 319 bp, Diabrotica virgifera
  unsure (1)..(319): unsure at all n locations
  Clone ID: pGUT377
gccctttgtgaaaggatctgtgtttttacggtcagacctcccgcatatctattcacaagtttcatgcaaaatcttagttttagttcggtagcctagcagtgtattaatactagagtgtacgtgtgttaagtgacgagtgttttgtntgctgtaattattttgaatattggtttagtatttcgtttggagagtgtcaagtgttgattattgtaatttaattaatgtgaatagtgatgtggcgcccgtgggataatgtanatatcgcgtacgataacgctgatattgtaaaaattgccagtgctagtgtgaatgtaattac

SEQ ID NO: 8911 - DNA, 441 bp, Diabrotica virgifera
  Clone ID: pGUT3773
cgacgatggcactctcaccatcttgggagaaaatggaaagaaatcgtcatctcaaacgccattgaggcactggaccaaaagacattgaaatctcaatcaatggaccatacggagcagtcaagaagatctcagtaaatggcgaaaccaacgaaagaaccatcagcctagtcgaaccaagcttgtctgagcaatacaacactgacgaagaagacagagccaagagaagcagctccaccaaagacaaaaaagacagcaaaaactccaaagacaccaaagagtacaaaggaaaggaaggaaaatcgaaaactcaagctcaattacttcaagaaatcttcagcgaacaccaagagggcaccgatgccaaatcctatggagaactcttaaccaaagtcgactactacgtaaaatctggtcagcttagcgctggtgtttatgacgtca

SEQ ID NO: 8912 - DNA, 202 bp, Diabrotica virgifera
  unsure (1)..(202): unsure at all n locations
  Clone ID: pGUT3775
atatatgataaaaatacaggtaaaatgctatttaaatgaatatattataatcttattaattcatatatttatttaattacgttaaataaatgtcacgaattcttaaaaaaggggggaaacgtggtattaatntagaaaaaaattacggaagtaataatatcaaagactagtaccgtgctaaaaccggtgcaaccttagtgtg

SEQ ID NO: 8913 - DNA, 426 bp, Diabrotica virgifera
  unsure (1)..(426): unsure at all n locations
  Clone ID: pGUT3776
gtctcgagnnnnnntttttttttttattttnctcaatcccggtgggggcccgggtaacctgggtaaaaccccccaacttgcgcctttgtgaaagcccaacttgtttttggttgggtaaactnaaaatatttatttaaaaaaaaaaaaaacctcctaccttttgcgggggggggctttttttaaaaaaaccccccacccccgtcccttttaatggaaaaaacaccaattttttcatttggaaggtggttaaatatttaaaaaacccttccccccccccggggttaaggggaaaaacccctgccttttgattaaaaaaaaccggaggggggggggttccaatttcccccggggcaaaaattttttattttttttaaaataaaaaaaggattttgtttttggccttgggggaatgggccccccccgggg

SEQ ID NO: 8914 - DNA, 482 bp, Diabrotica virgifera
  Clone ID: pGUT3788
gtgaaagtggtctctagaaataaaaaaaaccgcgactggttagttacatgacgggtttccattcaagtgttgtgtgtttattgacttctttctttaaatacatacaacaacaacggtgataattcctgtaattattattcaagtgtatttataattgtgagcgatcaaaagtgtaaaaataaaacgtcggtagtggattgcgtctaataggaggcatcgttttttcggtaatcatttctatatttttgcgaatttatttaaaaataaatgaaacaaggacgcatttaagtggtgctgattatgtctgtcgtgaaaatataaaatagtaatgcggttaatttgatatcaagggagcgtccagcgatgaatggaaccattatcagtcgaaaattaacgtgatacggtgcacatctagttttcccgcgtgacaaatgaaattttcgaggtttttctcttaaatggcggacaccgagaacgaggaa

SEQ ID NO: 8915 - DNA, 172 bp, Diabrotica virgifera
  unsure (1)..(172): unsure at all n locations
  Clone ID: pGUT3803
ataaaaaaaaaaacccancccccataccccccttttctttgtcggcggccaccacaaaaaaaccaacatcttttcactcctctctttggggggggggggtctcccccccgcgcgcggcgggattttaataacccccctcggggggggggggggccacccctcttttttcttt

SEQ ID NO: 8916 - DNA, 253 bp, Diabrotica virgifera
  Clone ID: pGUT3853
acgataatgccaaatcaaggtgggaaggtgggggcaagggttacatgtgccacaagtcacaaccatgggccataaataacacttttgcatacgggttttggggcccggtcttcaataacggaaatgatgatccttatgttgcgctcgcttcttacttagcttcaaagatcaaatttcaaacaagaaaatgattgtacaagttacaaatactgggtctgatttgagtcataatcattttgacattgctcttccc

SEQ ID NO: 8917 - DNA, 341 bp, Diabrotica virgifera
  unsure (1)..(341): unsure at all n locations
  Clone ID: pGUT387
cacaattatagctattttgcaacaaggtctatttttgtaaatatttaaccaattctatattgaaggaaatttaattacgcaacttttatttcagtacaacttttctcggaaatgaatactgttaaagttataatcaaaaaaccaagaaaaaaatcggatttttccttaattttttgacattttgattatttgaacaatgttccggacctttttgagatggatgataactcanatattattatttgatttattttcaagcaatttctgcaaaaaaatttgagtcacatctcaacgtccaaatgtaccaatatnnttacagatgcgccctggtctatgacacg

SEQ ID NO: 8918 - DNA, 276 bp, Diabrotica virgifera
  Clone ID: pGUT388
gctggagggagcacagttgtccatggacccaacagagctcaaccagcgtggcatgtacgtggtacctgcagattcacgagatcacctaaaccacattgggaagtgaatccaggagctaaccgtgacgatgatggtaatactaatgctggcgtctcattgataaatcatggaaacgatcatgatttcgaagcatgatggagcacagtagttactggacaccacagacctcatccaccatgggctgtccgtggtccctggatattcatactatccccg

SEQ ID NO: 8919 - DNA, 363 bp, Diabrotica virgifera
  Clone ID: pGUT3882
aaaacacgaaaatgtttggttttgtagtaactatttgtttgcttgtaatatctgcacagggacaaattcctgttgaaagatgtccagatgtaaaaggagtggaaaatttcgatggagaagcctatttgggtgattggatcgaacaagcaagatacccaactttactggaagaccacggagaatgcgttgttaccaatattgcactagaccttaatggagttgtaaaaagtcgtaccacatatactaatagcgaaacacgcgaagtacatgttctcgaaggagaaggagtatcaaattcaaccacaggagaagccaaatttttagtacattttcttaatccagatgtaactgtacctttttggg

SEQ ID NO: 8920 - DNA, 370 bp, Diabrotica virgifera
  Clone ID: pGUT3888
cacaaatacatgggaagacgacttacaggggaagaagaggaaacagtcgaacaatgggttgcatcgaatctttctgatgagtttttggcagtgatgttatcattcaagattaaggatacatatatgttccccgcaacacttttcaaagaagaacttgtcaaaaaattctcaacaaagaaatggtggaagctgatatcaataaaaaataaaaaaacaaataaaataccatatgaattttgtatttatatgttatctttgttctcatgtccagcttcatctgcatctattgagcggattttttcttcatatggattaatatggactaagcttcgcaacagattaggtgaacttggtaaaaaaatataatcat

SEQ ID NO: 8921 - DNA, 321 bp, Diabrotica virgifera
  unsure (1)..(321): unsure at all n locations
  Clone ID: pGUT389
tatttgcgtacacgttggcgtgtacctagacacagcgaaatataaccataatcaaaactaatgcaaaactatgtgacgtcacgggccgtttgaactattttataccgtagaagactttaaatatgtatttctaagttattacgagtttttgaagagtgaaattttggaaatctcatttttaaacaaaactgtacattattatctaataaaaaaaatgtgcaagttcnctattggccaatataattaaaagtgcgaaaaatgttgctgagctatgaaacccagtgtcgcgtcgcttttccgaacttgcacggtcccaataaa

SEQ ID NO: 8922 - DNA, 315 bp, Diabrotica virgifera
  Clone ID: pGUT3898
aagctaccatatttgttgatgagattgcattggcgacagatcaagatgcagatcatatatcgggtgatgtagacaacgactaccacaaatattttaaagcttcatacgacaaatctaaagtaacaataactaaaactgccgatataccaatagctgatcttaagagaatttcaacaatatctatacaattaaaagcaacggtcaagaattccaaagtcgaggacaacactgtaataaacttattgattatcacagatgatactccgacaccagagcaaggaaaaataatgtttgacaacactataaatactggcg

SEQ ID NO: 8923 - DNA, 222 bp, Diabrotica virgifera
  Clone ID: pGUT390
ctcgagtttttttttttttttttttttttatttttactataactattttgtaactgggcaggtaaataaatcctatctagtactaaacctgcctattatttcgattaagaacgagaatatgatgttatgttaatttttttaataaaattttggcatagtttatatacaatatacaataaaattcaaattttattttgaaacacaattacatataataataat

SEQ ID NO: 8924 - DNA, 311 bp, Diabrotica virgifera
  Clone ID: pGUT3903
cgatttttcggcgagggtatgagttccgataagatgtttaaggagatgatgacattgaatatattttaacatgttagcttgcaaccccccaacttgcaaccaacttacaaccaacttgcaacaaacttgcaaccaacttgcaaccaatcggaatgaaaccaaacacttctcgatgagaataggaaaagctactcccgacgtcggccgaaatcggatcttgatctgatcggagaaaaacggatccaatgtaggcacccacatttaatacataattatctacaattactaaaggttcgtaagtttcctctgga

SEQ ID NO: 8925 - DNA, 337 bp, Diabrotica virgifera
  Clone ID: pGUT3913
gaaaagggtaacgaggcggccaatgtaaccggccctaatggtgacccagtaagaggttcgccttatgctgccgaccgaagaagaggataccgccagtggtattacccgagaggaagacgtggacgtcgtggcggtagccgaggcggcggaccgccaagggaaagccaaagtgaaggcgaattaaaggatggggtacaatcaggcggtgaaggcggccaaggtggccaaggacccccacgtcgttatgcaccaagacgcggacgtggaggatattcatattacaggggaccctatcgcggaccgccaggagaattagaacaaaatggagatgctcccc

SEQ ID NO: 8926 - DNA, 259 bp, Diabrotica virgifera
  Clone ID: pGUT3929
cggcacgaggccttgcccttatctgttctaaccgcagccggaatgaagggcaggcagaaacaaaaactgtcttttttgaaactataaagaaaggtatgtttaagttaaaaaccggtaaatttttttaaatgacgagaagaccctttaaagtttaatgctattattaatatgattgactaggataccctatattgatataataaatttatttaatgggggtgataaattaaaaaaattaactttttttatataattatat

SEQ ID NO: 8927 - DNA, 299 bp, Diabrotica virgifera
  Clone ID: pGUT3934
caaaaagaaaaaggtgattaaaaagagagtaattaaaaagcacaaagatggaaaacaagaaaagactgaaattgtgaccattgaggaagaaggtagaaaaccggaaacaacagttactgttgaagaacttgaggaactcgaagaggtcgcaccggaaaagccaacatacattgttgaagaattgccagaagaagtacaggtgacagaagtagtcaccaaagaaggtgacaagaaaagaaaggtcattaagaagagagtaattaagaaacaaaaagacgggaaacaagaaaagaccgaaa

SEQ ID NO: 8928 - DNA, 160 bp, Diabrotica virgifera
  Clone ID: pGUT394
tgcagatttatggcccataattgcatcaaatgcaagcagtattgcttgatgtgtatatgtttaagaaaaataaaatacgatattgtccttataaaaataaacaaacatcaacaatttcgtcctccgcggactcacccatctctcctaccagacttcccca

SEQ ID NO: 8929 - DNA, 337 bp, Diabrotica virgifera
  Clone ID: pGUT3946
gaagaagcatctcctggctgaggaaccttagagaatggtttaactgtagttcattacaactgttcagagcagcagccaacaaagtgaccatagccattatgatatccaacctcctataggacagggaactttaagaagaattcttcagctgtgtactattggcgaattacatttggttttgtaaattttaattttaatcgagagtagttgataatttaatttttctagtaataaaaatagaaggtcgtagaaaaaatatagcatagtattctactcgcatgtaatggctattactcactctgatgaattaatgatggctattactcgcaaacttcat

SEQ ID NO: 8930 - DNA, 525 bp, Diabrotica virgifera
  unsure (1)..(525): unsure at all n locations
  Clone ID: pGUT3951
gcaagtctttttgctagttagaatatcaaattgataaacatgaagttcgtattggtcgctctagttttggccgtagtggtgtgccaagtgatatgtgatggtgatgatactggttcctccagcaccaccatcgcggtcaccaccagcgaagctccacctaccaccaccagttcgaatgcggaacaatcatcaacaacctcagcacctgagagcagcaccaagggtggtgcatctacggccattcccgcaataggacttgtattgggaaccgctttactgtgtctccactaaaagcagaaaggancgctttgtatagtcactgttcactttaatacactcacttannatattattttcgaaaaaaatatcaatttgctcaaaaataaacatccgactacaaccatataagccctaaatattgatcgaatactcgtggtttaacgctgttgttataaaaatacttatttttgtggaaaaaaaaaaaaaaaaaaaaaaaaaaatatgggggggggccggccccccccc

SEQ ID NO: 8931 - DNA, 295 bp, Diabrotica virgifera
  Clone ID: pGUT3952
gcgacctgaaaaacgcagagcaaaccagctgcattatctccttcacaattgtcaatttcttcggcggcgtctcttgcttgcttatggatgtcagttagatctttgagcaaaggtgcgccagtgttaaccaaagcgacgatgctatcttttacgcatttgccggcaccttcgacgagagcgacgcggatattgacgagatcagcttcgtgttgttcgacacaggaaaccatggatattctcaaagttgaccttcagattcccgaagctgtgaaaggtgatatccaacccgtcattg

SEQ ID NO: 8932 - DNA, 290 bp, Diabrotica virgifera
  Clone ID: pGUT3955
gtaaagttatatacatatctaataataattattataaattattattctatcgtcagcatgagaagtttaatacttgccacgattgtactgttcgccgtttatcagacagtagatgcagatggtctaatagcctgccacccaaacttttgcaacgacagtcacggcaaatgtacagaaaacttggtttgcagtgattctgaaattttggttccaaagggaactctctgcggatgttgcgatgactgctacagaaaactaaatgaaggcgaagcttgaggtcacgttttttc

SEQ ID NO: 8933 - DNA, 297 bp, Diabrotica virgifera
  unsure (1)..(297): unsure at all n locations
  Clone ID: pGUT3959
caaagtagacagatacaaacgaatataaaatgaacaagtatatgattttagctgtcctcctggtaggcgctgtcctcgttcagggcaaaaaagaagactccagcagctcatctgaagaaaatgtcagagaagtagcagaattattgaacaagaaattcaacaccacccttcttcttgatgttatcaaaatggccgaaaaagctaaagcaaaatgtccagacttggaagaaaaacttgacgatatttccggaaaaatngaaaaatgcgttgacgaaatcgaacttggatcagaaactt

SEQ ID NO: 8934 - DNA, 250 bp, Diabrotica virgifera
  Clone ID: pGUT3967
ctcgtgcccaaatccggacgaaccaagtttttttttttttttttaaattttgggaggttttattttaaaaaaacctttaaaaaatgttacagggatgtgtttacaatgaaatgttcattaaactgggggaaaactaacggtccaggtgaaacaacatggggttgggggtctttgaattctaaagaaaccttttttaccccaagaagctccccaggaattttggacaatccaaaaaagggggccatttttt

SEQ ID NO: 8935 - DNA, 310 bp, Diabrotica virgifera
  unsure (1)..(310): unsure at all n locations
  Clone ID: pGUT3995
ccgatgccaagtcctatggagaactcttaaccaaaggcgactactacgtagaatctggtcagcttancgctggtgtttatgacgtcatccgcagcttgagagacttcaacaacggtgttactcagtatggaaaccaacaaccacttagaaatcctggataccccgtagacaccacagtaccctcatactaccaatcacctgagcagtacccatacccttcatactccccttacggatatggatacaacaactacaacaatcttggtggatacggaggagcttacggtgttaaccaaggactctacccatc

SEQ ID NO: 8936 - DNA, 390 bp, Diabrotica virgifera
  unsure (1)..(390): unsure at all n locations
  Clone ID: pGUT3996
cgagnnnnttctttttttttttcttttttttttggtgttttctttgaaaaaagggggaaaatttttaatcctttttttttaaaaaaacgggggccccccccttttttttaaatatttaaaaaaaaattagccccctttttttttccccccccttttttttcccccccccccccctaaaaaaacccccttccccccccaaaagccccccaaattttttttaaaacccaaaatttttttccttttttacacccccacccaaaaaaaaaaattttttttttaaaaaccccccccccacacccttttttttaaaaaaaacccccccttttatgttcccccccccccctttttgtgaaccccccatttattttgccccccccccccccccccccc

SEQ ID NO: 8937 - DNA, 329 bp, Diabrotica virgifera
  Clone ID: pGUT4001
tgcacgaggagcaccatctcaagggggttttttcaaagggtgggggggcgtacccaatgttccattggttaaacatgggaacaagagctactttcttggagttaactacaaggcaaactttcaagaggctcttcagttctgtgacgtcctttacatgaaactattgaccattgagtcacaagaggaaaatgatgctatcaaaaaaatgatttttgataataaaggcagtggtaccgaatactggacttctgctggcaacttcctgggcaatagaaacttcgtctgggtgagcacaggaaaaactgtgggatacacacgatggaacaatg

SEQ ID NO: 8938 - DNA, 166 bp, Diabrotica virgifera
  Clone ID: pGUT401
tcaaaacaatgtgactttactaggcaatcgtagttcgctacgactgtcgcacgagcccttatttccgttgagattatcggtttacggtgggatcgatccttgccagtagaccagatctttagacggacgaacatgggtattataatcttttcgatgttggaactcg

SEQ ID NO: 8939 - DNA, 336 bp, Diabrotica virgifera
  unsure (1)..(336): unsure at all n locations
  Clone ID: pGUT4018
attggttttgcagtaactatttctttgcttgtaatggctgtacanggacaaattcgtgttgaaagatgcccanatgtaaaaggagttgcaaatttcgatggaaaagcatatttgggtgactggttcgaacaagcaagatacccaactttactggaagatcacggaagatgtgttgttaccaatattgcagtaaactcaaatggatctgtaaagagtcgtacgcaatacatcaattccgaaacaaatgagacacatgttctcgaaggggaaggaatatcaaattcaaccacaggagaagccaaatttttagtacattttcttaatccagacgtaact

SEQ ID NO: 8940 - DNA, 416 bp, Diabrotica virgifera
  Clone ID: pGUT402
cgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacccgagcacaacgatgccgttgattagccgaaggattcattgatcccagaactcctgtggaaatgaacagtcttccccgtatacatccggcgttgaatatcaactggtttaacaccttccgctgtcagaaacctgataacgccccgctgctcctcaatcgtcgaatattgcaatgtgaacgccatgatgtgctcacacgaactgtcgcgtcaattggacggctctcttataaaagcctctattctctcctggccatgcgggcgcccg

SEQ ID NO: 8941 - DNA, 385 bp, Diabrotica virgifera
  unsure (1)..(385): unsure at all n locations
  Clone ID: pGUT4020
caacccaaggaccaggaattcctatcatgccggtattaagggcaaggtaaccagaacgaggagcgggaatttttataccaaaaatataacaatttttttgagcaactataacaaagctgatagtcttaaaataagtgagaaatgcaaggggacaactgggtctaaccatagtgaaatggcgtataacgcaatgaggtgtgttatatcaacgctcaacgacattccagacgaagagttgatataacattcacatactagcaaatttttaaaatattttctaccattacttgctattaaaaataatttgggaatttaatttaatattatntatgtttaaaaactcttttaaaattgtaaaaaaaaaaaaaaaaaaaactcagggggg

SEQ ID NO: 8942 - DNA, 365 bp, Diabrotica virgifera
  unsure (1)..(365): unsure at all n locations
  Clone ID: pGUT4039
cggccaggcgcatacgcgcattataanctttttgtgattggatgttcaaatgacgtgtcaaaaattatccaatatggcagctgtancgcanctgtgggctgtggtttggttatgtcgttgattgataaatatagagtgattggtatactgcctttttaaatagttttcatattatatttttggacttattaacatgcttgttgcatgtcattgtggaagcccaaactgtgtgagtgcgattttcaatcgcaaaattactgataaaaacctattggctcgtagaggtagtgtagagattctctacactagagaactgtggataacatcaatcaaccgggacgaatttacgatctcacttattcaaa

SEQ ID NO: 8943 - DNA, 213 bp, Diabrotica virgifera
  unsure (1)..(213): unsure at all n locations
  Clone ID: pGUT4040
tctctctctctctctctctctctctctctctctctgtctctcctcgtgccggagggggcgcgatctctctccaaattncncaccagcgtgccaaattcgacaagacacaaaaaagagaattgtagaacacccactatatgtgcgccagaaatatatacacacacacaaatccctgtaaaaacatatccatataaaaaaagatttacatattta

SEQ ID NO: 8944 - DNA, 300 bp, Diabrotica virgifera
  unsure (1)..(300): unsure at all n locations
  Clone ID: pGUT4042
actctttccgagggcggcactanaatgcatgggggggttctcatttcccccattcttctctgtttaaccataaacctggagagatttctctttcctctagttctttctcaattccctccctccagcttcttctcggccttcctctttttcttctcccttgtgggggccatgccaaaatctgcttatggatcctgtcatctggcattctctgtacatggccataccggactagttggtttgtttttatgtcatcaattattgattgcgtgacttccatcatttttcggattctctcatttg

SEQ ID NO: 8945 - DNA, 244 bp, Diabrotica virgifera
  Clone ID: pGUT4045
attcggcagagctcgagtttttttttttttttttgggttttaaaaaaaaaaaattttccccttaaaaacccaaccggggggaccttttaaaaaaaaaatttttaaaaaccccccgggggcctttaaagtaaaaaaaaaaaggggcccggaccaggggccaaaaaggttaaccggaaaaaactttaaaaaaaggccccaggggttaaaattcccaaggccccccttcaaaaaaaaaaaagggggg

SEQ ID NO: 8946 - DNA, 271 bp, Diabrotica virgifera
  unsure (1)..(271): unsure at all n locations
  Clone ID: pGUT4055
gccgctctaagggtggatcccccgctctggaaaattctcacaatttcggcccttcgtactattttttctnccctctcggggcaaaaagtcttattggcgcgaaaatccnaataatccacaaaaatgaaaatttacaaagacattttcacaggggacaagatgttttccgatccctacaaaatgaagttaggggatgaagtaatctaccatatttatggaatgctcatccaacgtaaacaaggaaacatccaactcgatggagctaaccctt

SEQ ID NO: 8947 - DNA, 256 bp, Diabrotica virgifera
  Clone ID: pGUT4068
caaccttatcctaaatcttgaaaactttatttttctaagggtgccttttcgtcggccgctggggcttcctaagatttttgctatcaatactcaattaccgcattcaatccaactgctgtcaaatatttttacaagtttaaattgacatccaaatttggagctatcgacgcacattaatctgacctacagaagctcataaaccatcatttcatcagatccttccagtatctacttctaacccccaattttgccacat

SEQ ID NO: 8948 - DNA, 84 bp, Diabrotica virgifera
  Clone ID: pGUT4070
aaccttggggggtttttaaaggggggggcgggtattcaaaacataaaaaatttaaatttacccttttacccaaaccctttaaaa

SEQ ID NO: 8949 - DNA, 414 bp, Diabrotica virgifera
  unsure (1)..(414): unsure at all n locations
  Clone ID: pGUT4076
aagaaggtgaaggtggtattatttcttgtcttggggaatcgaaagttagagggagagaaatggcgggtggtgaantaagtaaaacaacaaaaccccaactaagaggtctcctagctggacaaattaaatggaatattatcattgctgccactatggctgctgcagctgccatagcccaaaaagtgtttgtcaatgatcagagaaagaaggattatgctgcattttacaggacatatgatattgagaagtccttcaaccaaatccgaaacaagggtttatttgactcctgtgaaacccgatactaagaagtcataaatcattagaacatnatagatttttttttttttaagtataatgatgggaaggttggccatataatttataccacnaaaaaaaaaaaaaaactgggggggg

SEQ ID NO: 8950 - DNA, 345 bp, Diabrotica virgifera
  unsure (1)..(345): unsure at all n locations
  Clone ID: pGUT4080
gaaagaccgaatttccaagaccaaaaatgttttgcgccttcttcaacaagggctgtggccaagctttacctgaaaaccaaactttaccacaaccagttgacgactcaccaagggcattagtaaaatcattggtagctggaagacagattgcagcagctgctgctgctgaaagtgacagttgtgaatttggatcagcacactacttttctctttgtggtctaggaggtatcctctcatgtggtatcactcacacagctgtagtaccacttgatttaataaaatgccgcatccaataaatcctgctaaatacaagagtgtatntaattgttttaaagtaaccctttc

SEQ ID NO: 8951 - DNA, 312 bp, Diabrotica virgifera
  Clone ID: pGUT4084
tgttcatttcacgaaatatagcgggattcgtattgaaaattgtaaatttaccccctatcgctctccctgggggtcgtgtttggtatcattcgataaattttgtgacaaatattgagcatgtattttttagtttttagatctatcgttaatctcgcgaaatattcgcttttttcttgtgaaattttgtgacacccatttccttacgccccgcccaaatcgtcagattttttaaatatacactgttttgtatgtacttaacttaccttatcttaatctgacgatttcgagtttttctaaggacagaattttttt

SEQ ID NO: 8952 - DNA, 406 bp, Diabrotica virgifera
  unsure (1)..(406): unsure at all n locations
  Clone ID: pGUT409
cgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacccgagcacaacgatgccgttgattatccgaaggattcattgatcccagaactcctgtggaaatgaacagtcttccccgtatacatccggcgttgaatagcaactggtttaacaccttccgctgtcagaaacctgataacgcnccgctgctcctcaatcgtcgaattttgcaatgtgaacgccatgatgtgctcacacgaactgtcgcgtcaattggacggctctcttataaaagcctctattctctcctgcgcatg

SEQ ID NO: 8953 - DNA, 291 bp, Diabrotica virgifera
  Clone ID: pGUT4092
caactcccgcgtaaaagcaaccttgggcccaaggtgaaacgtgaagcggatggtaggagaaacccaaatccaaattttcaaacaaatctgtcttgacgagaaaaattacagtccaaaacgttcatttactgacctataggttcgcctgatccatttcgtgagtttcgtagtcctgaaaatgaagtccaaggaattccgggcgcgtcaggatatagtacaagagtttctgggtacacagctcgttatactgtctttgtccgtcactgaacccggcgtcgtgggcgtgctcgt

SEQ ID NO: 8954 - DNA, 304 bp, Diabrotica virgifera
  unsure (1)..(304): unsure at all n locations
  Clone ID: pGUT410
ttcagattttaaatcgcccttaactcgaaatctatcaacttttgagaaaaatggcaacatacctttcttgttagaatggcccaaaaaacctaaaaaaatatgttccggagcaaaaagggtgatcttttgaatttcttaaaaaaaaatttttaaacaatttctggccaaaagtttcgccctgcgcacttcatatttccttaaagggaacatntctgaatgggaatacgcacagatgccgaaccatgatttnttttagacgggagcggcatcacgtcatggactaaatgtttctngccaacattac

SEQ ID NO: 8955 - DNA, 526 bp, Diabrotica virgifera
  Clone ID: pGUT4111
cccgcgaaaaaaaaaaaaacccccccctttacttttaagggggggcccaaaaaaaatttctccccctttaaaaaattttaaaagaccccccttttaaaaaaaaaaaaaaaaaaaccctttttaaaagaaccccccaaaaaaattttttaaagccccaaaaaaaaaaaaaggccgttttttttttaaaaaaaaaaatttttaaaaaaccccccaataaaaaaaaaaaggggggggagaaccctccccaaaaaaaaaatttttttttttttaaaaaaaaaaaaaaaaacaaaaagggggaaaaaaaagttgggggaaaaaaaaaaaaaaatctcaaaaagcgccgcgccaaaatttctctttttaaaaaaaaaaaaaaaacccccccctttttgggggagggggggggaaaaaaaattggataattaaaaaaaggaaaaaaaaaccccccccactaaaaaaaacaaaaaattccccccccaaaaattttttaaattttaaaaaaaaaaaacaacaaaaattttttttt

SEQ ID NO: 8956 - DNA, 330 bp, Diabrotica virgifera
  unsure (1)..(330): unsure at all n locations
  Clone ID: pGUT4112
cggaccaaaaatatttatttccgggggtgcttttaataaccatcggggactaaaaaggcaacagtatttggaagccaaattatgtattaaatagccacacaaatatttttgggactgtaattgaggaatccatctttatgatgaactcagatatgatgacaccagaactaatcttcactgaggatattaacacaattataccatctagataacaaaaaagtccaaatattaatgaggacttaatatggttcacttcactgatggatttatagctgcccatggtattggatcaagagtctnttggataacagcgtactataataaaaatta

SEQ ID NO: 8957 - DNA, 243 bp, Diabrotica virgifera
  Clone ID: pGUT4129
tcgagttttttttttttttgaaaaaaactaaacaggaatgcttgccgctaaagtggggttacttttggcccttccccttttcgtctaagctggccaaaaccttgacaagggcatggaaattgtaaaatgcccccaccgagcaataagcgtaggagtccctgaattaggagttccatcccataatcccttcgtcgtttttaaaaacgtatcatggactggatcaatcggggttgcaagccccca

SEQ ID NO: 8958 - DNA, 326 bp, Diabrotica virgifera
  Clone ID: pGUT413
cgagttttcttgacaggtttttgtattaaaacgaattttcttcctaggcaaaataaaggtcttagttactaataggttgttcaaatgaaaatgtacgaaacgacactgtgggtataaatgaagtctttattcaaagtattcaccatttacccgagcacaacgatgccgttgattagccgaaggattcattgatcccagaactcctgtggaaatgaacagtcttccccgtatacatccggcgttgattagcaactggtttaacaccttccgctgtcagaatactgataaccgcccgctgctcctcaatcgtcgaaatttgcaatgtg

SEQ ID NO: 8959 - DNA, 165 bp, Diabrotica virgifera
  unsure (1)..(165): unsure at all n locations
  Clone ID: pGUT4132
aaattganaagggcctaaaaaaaaacatatggggttaaaacccaaaattttttttttttttttttttaaaaactgcccccaaatttgcaaccaatttcaccagaacattgaacttggccaaaggccatttttgaattgtaacccttcgggtaaaaacaaaattta

SEQ ID NO: 8960 - DNA, 319 bp, Diabrotica virgifera
  unsure (1)..(319): unsure at all n locations
  Clone ID: pGUT4181
atccgcacgatttacgggcaaaaatcttctaattttcgggggttttcatttttataacaggttttgaaaactggaaccaccatgaagtccgntagtttgtttgaatttttggcttgcattgcaggtttatatgctattcagctcaaatgtgcccaccaagaactgaacattcctaatgaatggatcgatatgcacaaaaaatgtgtgcacaaaatgagaggtcaagttgaagaggaacttatagcttaatgcaatacatggccatgggtgcccatttttcgaagacaccataaacagaccagggtttgctgacttgttc

SEQ ID NO: 8961 - DNA, 587 bp, Diabrotica virgifera
  unsure (1)..(587): unsure at all n locations
  Clone ID: pGUT4185
agagagagagctagtctcgagttttnnnnnnnnntggggngnttnttttttttttttgtgttttnnnnagagagcccctttttttttcccgaggggggactttgggggttaaaaaaaattttttgggggggggggggggggggcccccccccccccccgggggttaggggggggggggggggttttgtccccccctcgggggggggggggtgggggccccccccggggggggggtcccgggggggggcccccccggggggggggccccccccccgggggggggtggggggggggagttttaaaaaagggggggggggcccccggggggccccccctttataggtgtgggcgggggggggcacataggggggggcgctttttttccggggggggggggggggggagggaggttccccccggggggggggggggggacccccgccggcgtttgggggattcttccccccgcgggcttttaaattgggggggggggggaacttttgggggggatgaggggggggggaaaaaccccctttttttaaaaaaaaaaaaaaggggggggggggggcccccccccccgggggggg

SEQ ID NO: 8962 - DNA, 279 bp, Diabrotica virgifera
  Clone ID: pGUT4206
cgtaaatattcaactaaaaagatggtgcagacacacgtcattcaaggatacgaaaaattccaagagtttttcaagaactttgatagccagggccaaaaagtgcatgtcttgtattccagccctagaaagccagacaacacaagttggtgtacctactgtgtcagagcttggccagttatagacaaagaattggaggcaactgatccaaattcccattttgtcagggtcgaagttggtgatatgccaatatggaaagatcccaactgccctttcagacac

SEQ ID NO: 8963 - DNA, 290 bp, Diabrotica virgifera
  unsure (1)..(290): unsure at all n locations
  Clone ID: pGUT4215
cagaattcatcgacactttccctggccaggttgacgaccaccttggttaaggggctaaaggtaccagggcccggcttacctaaatcggtcaagccctttaaggtggtatagaataaggtgctggacaaaatggtgaaggctggaaaaaaatgggtttctgtgtcgaacacacgaagcagatctcggcnatatccgcgtcgctttcgtagaaggtggccgcaaatgcgtgaaagatagcgtcatcgctttgggtaacactggggcacctttgctcgaagatctaactgaaa

SEQ ID NO: 8964 - DNA, 318 bp, Diabrotica virgifera
  unsure (1)..(318): unsure at all n locations
  Clone ID: pGUT422
cggcacgagctcgtgccgtgaaaaaatccaaaaagatgttttgggaccacaaggacaaaaaaaagcttctgaaatcagagaaaacttacacgcacagatcaaatccgctgccactcaaattgaaaaacttactgcagctgtcaaacccgaagcagagaaagtgaagaatgacttgttggctgctgctaacctcttcttggacaaagccatcaatgttgccgatgacttgaaaaaagtagtcgctgaacacaaaaactaaatgatctagtatntnatatttatgatgttttanatntttatgtaatataaacaataaac

SEQ ID NO: 8965 - DNA, 326 bp, Diabrotica virgifera
  Clone ID: pGUT4228
cgggggaaaaggaaaacaaaactgtatgggggggtccagtccacgaaaattcgagaaaatcatacccttcccgtatcacacattgggtcgataaggcaaggcacacagctaccaaaagttttttgaaatatgtagaagaagcggacgatctcctcagcatttttgaaaattgcaaagtcgattgctacatagaattattttgcttatccatattaccagaatacagaagaagaggaattgctttgacattagcgaaagcaactgaagaactgactcgacaactatctcatgggaaacctgtgaaacagtcattagatgacagtgat

SEQ ID NO: 8966 - DNA, 367 bp, Diabrotica virgifera
  unsure (1)..(367): unsure at all n locations
  Clone ID: pGUT423
gtatatatacatttaatttcaatcttaatgattattaaaaataattgaagacattttgtgtatcaagtatcaatcactaacgaacgaaaaattaaatgtttaatgcaaattagacaggattaattaaagttacgcgaactttgattgttgcaaagaaatttcaataagtactacaaaatggcctacacagtttaccggcagtttgataacacggtgaccagtactttataagttggtcacaattttaaatgcgtttgttccataaatatnttagtgtgcctattcgtnttgcaaatatntaattaacaatttatatccgcagagatagacaaagttcattgataatggcggtcatataatggtaatg

SEQ ID NO: 8967 - DNA, 432 bp, Diabrotica virgifera
  unsure (1)..(432): unsure at all n locations
  Clone ID: pGUT4230
tttcgatttatggcaagtcaaatctgggaccatcttcgataatgtcctcgtcactgatgatgtagattatgcccaagaaagcactatcaggtcttaaagataaacaagagggtgaaaagaaggttaaagaagaacaagacaaagccgaaagagaatctaccagtgaagatgaaaagaaagaggatgacgatgatgatgatgaggatgatgatgcacaagaacatgtgccacaagtagaagaaggcgatcacgatgagttataaaaatagtgtaaagtgaactaaagagactttttttatatattacaggtgtgaagtgttttgttcgatagtgtgtactgttccctgactgagtttttgtatttttgatcngattacctctaataaacacacaatcgaaaaaaaaaaaaaaaaacctcgaactttggggggg

SEQ ID NO: 8968 - DNA, 166 bp, Diabrotica virgifera
  Clone ID: pGUT424
tcaaaacaatgtgactttactaggcaatcgtagttcgctacgactgtcgcacgagcccttatttccgttgagattatcggtttacggtgggatcgatccttgccagtagaccagatctttagacggacgatcatgggtattataatcttttcgatgttggaactcg

SEQ ID NO: 8969 - DNA, 239 bp, Diabrotica virgifera
  unsure (1)..(239): unsure at all n locations
  Clone ID: pGUT4249
gattttatatattccgtattcgaatgggcatcttaatataaatatggtatataaatctcatacgtaaaatcttctaaagcttagaataaatacagtattgcattgacactcaatttatattgtagactttttgagatttttaccattccaatgttagttcatttgcatttatgtaactgagtctatttttcaatataaaataattntcaaacagaaaaaaaaaaaaaaaacctcggggg

SEQ ID NO: 8970 - DNA, 97 bp, Diabrotica virgifera
  Clone ID: pGUT425
cacagttagtgtccatcacaggctgtggagatctttaaaataataattgtgtatttgatatttttgttggaatttattaaaaaatgttaactgctac

SEQ ID NO: 8971 - DNA, 360 bp, Diabrotica virgifera
  unsure (1)..(360): unsure at all n locations
  Clone ID: pGUT4254
gttaagttgacattgactgcagcagtgaacttgagggtgaaaatgcgggagggagaggtgctantttcgaaataagcggtccgcagcctcacgaagctctcaaaaatgagactttggggcaagcttttttgagagttttgttggaaaaatcgtatggacacaaaattatgattgactcgcacaccggtagagatctcacaaaccaaaagctgctggaggagtcatgtcaactggccgaagcattgagagtctatggttgtacctcaaatacagctatctgtataggaagcgaaaataatctcaagttctttgtaccatcaatgcttctatttttgcaggcacaatcatggcaccacttta

SEQ ID NO: 8972 - DNA, 300 bp, Diabrotica virgifera
  Clone ID: pGUT4255
caaccttgtagagaccttgagagtcataaagatggagtactcaagtagatctgtgggaggaagattcctgggatagcctctaacgatgctgattctgtactattcaaagctcctgttatatttagaagtacttgtctttgtaggatagtgagacaagaatacattccccgtccttatcaatatttctcttatcagtaaaagaactgattggattaggacttcttttatgactatgtttctattacttatcccgtaaaaaatctatcaggttccatctctttttttttttcactactttat

SEQ ID NO: 8973 - DNA, 159 bp, Diabrotica virgifera
  Clone ID: pGUT4268
tcgagtttttttttttttttttttttaaaaagggttttttttttttgggggcgtccaaaacctttgggggggggagatcccttggataaataaaaatatttaatccttttcaaattgggggataagggccaagcgaaaataccttttttgacattaaaa

SEQ ID NO: 8974 - DNA, 261 bp, Diabrotica virgifera
  Clone ID: pGUT4289
tcaatgatgacgctgataatgtagcggtctttgactgggtcaatagatggcccgtttttacaatctccggaactaccgagcaaccgttaaagaactgttccttacacagcattacaaaggaagcttcaaaatggtcatggagaaaccagtatggactgtaaaaataagcgcaaataaaatccaacccaacgccaccgtgaatgacttacttgtaaaggcacgttgatgatgtagatgtggatattagtggattgggactca

SEQ ID NO: 8975 - DNA, 302 bp, Diabrotica virgifera
  unsure (1)..(302): unsure at all n locations
  Clone ID: pGUT4296
tggggggaacaatttaaaagaaaatgggactctccactttcaagtaagttcctggtgaagtaaccaccggttttcagctccctaaaataaagctcgaaccattccaaaatttcttaaaaaacataagttgattccaactccacaaaattaagttaagcctggctgggtcctcagacaagatattaggtattatttggtcacctgatcaggatactttttcattcaagcctcctgtatgcgaggtaacatcgccaattactaagagaaaaattcttagntatgtctctcgnttattcgaccct

SEQ ID NO: 8976 - DNA, 314 bp, Diabrotica virgifera
  unsure (1)..(314): unsure at all n locations
  Clone ID: pGUT4304
atttattaaaattttattgcttaataatattaaaggattacaatacacgatctactttatagaacgcaagttcttatattctctaagaatacataaactcattccataagcacccggcattggacaatgtccaaataaatattgtaaacagttctgcgtaatcttgtcagttattcttgtcttctcttgcaggctaagagtatttgtagtggtttcagggaaaaacagttgtattaattntgaagcttctcttgggtcgtattcatcgtatttggttatcaggcctacagattttgtaaggcatagattaaacg

SEQ ID NO: 8977 - DNA, 303 bp, Diabrotica virgifera
  Clone ID: pGUT4315
ccgtaatattcaactaaaaagatggtgcagacacacgtgattcaaggatacgaaaaattccaagagtttttcaagaactttgatagccagggccaaaaagtgcatgtcttgtattccagccctagaaagccagacaacacaagttggtgtacctactgtgtcagagcttggccagttatagacaaagaattggaggcaactgatccaaattcccattttgtcagggtcgaagttggtgatatgccaatatggaaagatcccaactgccctttcagacacgaccccaaaaccaaattgcgagtt

SEQ ID NO: 8978 - DNA, 175 bp, Diabrotica virgifera
  unsure (1)..(175): unsure at all n locations
  Clone ID: pGUT4334
gttgaaaataagactaaaaaaccttctaagtattgacaaggcacctgtatagccatttgaaagtgacgttttttctcaaatgggataaacaagtangcttgggtcggcctattttttgcacttatggcaactacatattgntaggggagcaaagtatgctaaatgtgcagtcact

SEQ ID NO: 8979 - DNA, 275 bp, Diabrotica virgifera
  Clone ID: pGUT4339
actacagggtaccggtccgtcaagtaagggtttaccttagctcaattctagcgtccataatagggtatggagccagtacgtgggcacacaggttaaagaacgtgaaaaatcgggaaaaagtggatagagcacagagaggcttccttgttagaatgacaggagccttcagtacaacgccaacagaagccctaacagtgctcacaggagttttgccacttcatctagaaattaccagaagaggaagtcaatattggcttcgaaaacataatcctgac

SEQ ID NO: 8980 - DNA, 341 bp, Diabrotica virgifera
  unsure (1)..(341): unsure at all n locations
  Clone ID: pGUT4344
tttgatttcaatatttattatatttatttaaactttagaaaatcaatacaataacaagaatacattaactattattattatttgtggctatagacaaatgtaatgatatttcaaatattgctattttacaaaaattttaagttgtaaatatctgtttattattacaaaatgtgcgagttctttagataaatgtgtgtcttattcgattgtaacccgcangtattttcattgtgtacttcatacacttacattaagttacaataactttggaacaattacagccaatacaacagaagctaatgccacaaagctgaactgtatgcttggagctgagttacata

SEQ ID NO: 8981 - DNA, 106 bp, Diabrotica virgifera
  unsure (1)..(106): unsure at all n locations
  Clone ID: pGUT4348
ctcgagtttttttttttttttttttttttaaaaaaccggccttaaaaaaaaaangtttttaaaaccccaaacccttaaaatggaatttttaaatccgggtgttttt

SEQ ID NO: 8982 - DNA, 230 bp, Diabrotica virgifera
  Clone ID: pGUT458
tgttcaaactggactccacgcggtggcggcgctctagactagtggattccatggctcggggagcacgagttcagtacgatggtcaaacggatcgatccctttgatatcatcttcagcactaggtggtgggtactcccgtgccagacctagtatgtgactccgattgaggctacgcataccgcacagtctcacccctggtactcgtcctacacatgtctgcctcatcaggc

SEQ ID NO: 8983 - DNA, 273 bp, Diabrotica virgifera
  unsure (1)..(273): unsure at all n locations
  Clone ID: pGUT459
tgttaacggaagtttttggaacggaggcgatgcgaacggtactaccgcaggttcttttttcctttgttactggatcatctgtcctgagaggtaacagaatntgtatntnataatttntnttatttaattatatcttaggtatgttaaaactgaacgtatatgatgaaaataatgactgattgtgtattgttgactccgattcggcagtacttaatacatttgtttgttaaatntcgagttttgctgttaatcattgtatatatgatatatata

SEQ ID NO: 8984 - DNA, 261 bp, Diabrotica virgifera
  Clone ID: pGUT461
acacaagaagtacaccttcaccaaggtccagacatagtgttctgtgcaagttttagatttagttttcgtgctcgcgtatcagtgtatgtgcgcatctcaccggtaaagaagcaaatgtgtgtcgtgatgctttggtcactggatcttacatctctctgtccttgtttagacaaacaatttacttatcgttttcatagtgaagcagatcgtcaaaaaacttggatgtgaataaaaaaaaaacgattacttagttgtttatta

SEQ ID NO: 8985 - DNA, 345 bp, Diabrotica virgifera
  unsure (1)..(345): unsure at all n locations
  Clone ID: pGUT465
tctggaatatgcctttaagatgctcaactgggacaataaagggatcacaatagacggagaaaagttaaatcatcttcgttttgcagatgacatagtccttataatgatgacctaggagaagtaaaggaaatgctaaatgagttagatgctatctgctggaaaataggcctgaaaatgagcttttctaaaactaaatctatgactaatctgattcctagtggacagctgattaaacgtgaacaagatatagaactagtggaagagtacatttacttgggtcatganattaggattggcagagataacgaaacgtgcgaaataaaaagaagaattactcttgcttgg

SEQ ID NO: 8986 - DNA, 244 bp, Diabrotica virgifera
  Clone ID: pGUT475
actggaaccggggctctttgttctcttggcgtttaatgccaattgaatgccaacgcagaacaaaccaaatttctgcacgttcgcgtcttatctaactttactacgcttttgggttaacaaagagttcacctttaccacataaatcatccaaaccgtgaacgtccacgttcgtgaagctgggaattttcttgcactgagtataggtgttgggcactttttaaagcccactcagttactcattggg

SEQ ID NO: 8987 - DNA, 198 bp, Diabrotica virgifera
  Clone ID: pGUT484
agaaattccattggaagaagttgaaaaagaagtgaaagaattgtgcaaagttttaccaggagatttggaaaaattgtgcgaggacaagttaattccagcaatcgaccaaatgtacaaccagatggaagacactcctcctagagatttatgcgtagagttggaattctgtaattaatttgtttgttaaaatattataat

SEQ ID NO: 8988 - DNA, 180 bp, Diabrotica virgifera
  unsure (1)..(180): unsure at all n locations
  Clone ID: pGUT485
attcggcacgagatgttgaaatatctattcacccaggattcttcgaatctcttcattataggattgaagtgtacaggcaagcagaatctaccactgcagctgctgccacaacaacgcctgtgccttagaatgaatgtatttttttcaatacatttttaatgttcaataaatntccgtaat

SEQ ID NO: 8989 - DNA, 131 bp, Diabrotica virgifera
  Clone ID: pGUT486
gaaggctccagccaaggccgcaggaaagaaataaacggactgctacggtttttgcgtattgttaagttttatgcactttgactgtggtaatccgagttatatataaaataaaaatataaaaattgatatac

SEQ ID NO: 8990 - DNA, 131 bp, Diabrotica virgifera; identical to SEQ ID NO: 8989
  Clone ID: pGUT487

SEQ ID NO: 8991 - DNA, 170 bp, Diabrotica virgifera
  Clone ID: pGUT494
aattcatggaatgaagattggggagacaagggattgtttaaaatacttcgcggagaaagtgaatgcggtttcgaggatggtgttgttgccgcacctgcatatggttaatcctacataaacaaaatattgctataacgtttagttatgatttattttataataataaaaat

SEQ ID NO: 8992 - DNA, 195 bp, Diabrotica virgifera
  Clone ID: pGUT497
attcggcacgagatgttgaaatatctattcacccaggattcttcgaatctcttcattataggattgaagtgtacaggcaagcagaatctaccactgcagctgctgccacaacaacgcctgtgccttagaatgaatgtatttttttcaatacatttgtaatgtacaataaatatccgtaataaaaaagaaaataaa

SEQ ID NO: 8993 - DNA, 301 bp, Diabrotica virgifera
  unsure (1)..(301): unsure at all n locations
  Clone ID: pGUT500
actagggatacttaaactctaataacttaattacacacgtgtgtcattgtcgcactctattttgctttatacatactatcacaacccgaaagagttcttcctctttagtcttctgacccaattcacattgtcgaagagctgaattgcttcggtcggggttactgtgataaagaattcgattttcgtgacttccggcaaatntatcgatggtgtgatgaacagtgtctatctctataaagttccagtgaacttattctgannacgcaggattatgtctatattgcttttgctggcataaaca

SEQ ID NO: 8994 - DNA, 324 bp, Diabrotica virgifera
  unsure (1)..(324): unsure at all n locations
  Clone ID: pGUT502
gtctcgagttttttttttttttttttcgtttccccttagtacaaaaactcgacaagaatgtgcagattgcgcggcaatcccagatcacattggaaatttggcaacatcgatgttggatacgtttccataacgtngccaacctttcanaatataatatcatactccgactgattccaggaaactacagttccacaacaagtaaataataaacatntttatagacagttataataaaagataaatgttgcccattattgtggtaacagcttctaatgcctttgttttacataccgagcagactcaaatcaagcaaacgcaaaaata

SEQ ID NO: 8995 - DNA, 283 bp, Diabrotica virgifera
  Clone ID: pGUT503
tcgagtgtgggtttgtttttttttttttttatttttattttttttttttttttttaaaatctatcaaacttttatttatttagattcaaaatacgattatttatacattaacgttattaatccatgggtattcgtctggacaaagaacacacgcatccatgtttctatcctctgtcccttttttaactctgcatgtgtagggctcacaactggctccatcgggcgcgtcagcagttttaaaatcgctaattttaacgggattttttataaaatctaagacctg

SEQ ID NO: 8996 - DNA, 385 bp, Diabrotica virgifera
  unsure (1)..(385): unsure at all n locations
  Clone ID: pGUT511
cgcaattccaacttctaggctcgcgtctctttggcatctcggtacgaactactctccgtatcatttcctccagaggttcatcgttgtgttcgtcactttcttcaatggttcttactctatggcttcgtgaagtttgactagccgtntcgtgctccaatgcaatagcaagtgcttcatctanaactttcggtcttgctagtcgtaaggctttctgtagttcactctctttcaacccattgatgaaagtatctacggcaatntcttctaaaatactgtctggcgcctccggataagccaaccgcaccacacgagcaacatctgcttcaaattcttgcagattctcacttgttcgttgacatctacttcgcagttgtgctttgtatac

SEQ ID NO: 8997 - DNA, 408 bp, Diabrotica virgifera
  unsure (1)..(408): unsure at all n locations
  Clone ID: pGUT514
cgcaattccaacttctaggctcgcgtctctttggcatctcggtacgaactactctccgtatcatttcctccagaggttcatcgttgtgttcgtcactttcttcaatggttcttactctatggcttcgtgaagtttgactaaccgtttcgtgctccaatgcaatagcaagtgcttcatctaaaactttnagtcttgctagtcgtaaggctttctgtanttcactctctttcaacccattgatgaaagtatctacggcaatttcttctaaaatactgtctggcgcctccggataagccaaccgcaccacacgagcaacatctgcttcaaatccttgcagattctcacttgttcgttgacatctacttcgcagttgtgctttgtatacttgttgtaaatgagcatctccat

SEQ ID NO: 8998 - DNA, 295 bp, Diabrotica virgifera
  unsure (1)..(295): unsure at all n locations
  Clone ID: pGUT517
attcggcacgagctcgtgccgaatggtaccaaacacgacccccacggaggtgggggggggggttactttaaaatcttaaataagaactcctttctttatttcacatttggattctttgcgtaaaaataagcaacttttattcgaaacgtttnttctaattacngatangtggcgctataatcggagataacgggtgttgganatgggaaattaaattanaatatggaaagttccccactaaatggaaaatnatacttaactttcttggttttaaaactaataatcacaacccaat

SEQ ID NO: 8999 - DNA, 300 bp, Diabrotica virgifera
  unsure (1)..(300): unsure at all n locations
  Clone ID: pGUT522
aaaaatctaaagaaagaaactatgttataacagcgagcggcggcagatagatatgatacctacataataaaataaatatcatttagtataatatattatatagataaagaatacattacacgaaaatgccaacaccgaaacaatacatactactaatagtgaaattgtagaatatnttgttaaatntntttanatggatttttgtcaggcacagaacacacaccaatacacacagggcttcaagcaagaatacgagtattatcatcaaccgctatntatgttccatgtgcgaatcattct

SEQ ID NO: 9000 - DNA, 310 bp, Diabrotica virgifera
  unsure (1)..(310): unsure at all n locations
  Clone ID: pGUT527
gaatgttggggctatttcgttgctgtttaatcattatcttgttgtactaataccatataggcctaatactcaattcaaatctgacgtgagctaangcagccttcaatcttgtttggttttgtacctaaattgattctaaaagaagaagctagcgctccttgtcgcatgtacaaaangaaaaaaattgagtttgtaaacgccattttactatataactaaactatgtatgttgtnatcncgcatnntatagagtatagtataatagcagtaaccacttatatgtatatataaatattcaatactagctgag

SEQ ID NO: 9001 - DNA, 334 bp, Diabrotica virgifera
  unsure (1)..(334): unsure at all n locations
  Clone ID: pGUT533
ggttttggctgttttggcttgtgtcgctcttaccgcttacggtgaaaacgtccaagttaatgactttttgtgcgacacctgcgtaacttttgcatcaacagtcaagaaattcgtagacgaagaactcccaattgaagaagtagaaaaagccgcaaaagaactttgtgacctcctaccgggggatttgatagatttctgcgagaaagatntgcttccagaagtcgagaatatctacaatgatgtatccanaataacaccccaagaaacatgccaagatntgggattctgtgacgcttannanattannagaattgttgtaatatgcataactata

SEQ ID NO: 9002 - DNA, 227 bp, Diabrotica virgifera
  unsure (1)..(227): unsure at all n locations
  Clone ID: pGUT535
gacttcagcacgaggtnagctctgcgtttgtcaagtcgccatggatattctcaaaattgaccttcagattctcgatgctgtgagatgtgatatccaacccgccattgatgccggataagcccttcatacagcaggcaaaaactgcatccacgatcaagttcccgccttctatgctaacactggacaacttctgggtgaaattgctacatgtgctgctgcctacatca

SEQ ID NO: 9003 - DNA, 311 bp, Diabrotica virgifera
  unsure (1)..(311): unsure at all n locations
  Clone ID: pGUT536
attcggcacgagctcgtgccgaatggtaccaaacacgatcccccacggaggtgggggggggggttactttaaaatcttaaataggaactcctttttttatttcagatttggattctttgcgtaaaaataagcaacttttattcgaaacgttttttctaattacggatatgtggcgctataatcggagataacgggtgttgganatgggaaattaaattaaaatatggaaagtcnccactaaaatggaaaattttacttaacttttttggttttagaacctaataatcacaacccaataagttcccanancg

SEQ ID NO: 9004 - DNA, 283 bp, Diabrotica virgifera
  unsure (1)..(283): unsure at all n locations
  Clone ID: pGUT539
tggactccacgcggtggcggcgctctaaactaatgatcccctggctgggcgacttgagttcgagccgataagttattagtgcaaacgtttaattatactagagtgtatttaattttgtgtagttattgaaatacgatcttcattttatacatcttgtttttaagacgatatattacagtagtacggtaactccattaagaaaattgatgtccgaaaactaccaataaagtttttcanaatgtaaaaaaaaaaaaaaaaaactcgcgactagttcctcgtgccg

SEQ ID NO: 9005 - DNA, 224 bp, Diabrotica virgifera
  unsure (1)..(224): unsure at all n locations
  Clone ID: pGUT540
ggcaggctcttgctcaccctagccgccatgggattctagttgcgaaaaaccttgcacacgcaagtgtgccttacaacctagtaaatatgacagccaatatggcgcctttttcgtttatcgccgttccggcacaatcgctatcttttactttattggaaagtctntccgaagcaagttacataagcagcaccgtcctcttccacaatgagttctgtgctggtatg

SEQ ID NO: 9006 - DNA, 308 bp, Diabrotica virgifera
  Clone ID: pGUT542
gggacgagcgcgggacgcacgtgcccaatacgggacgagtttggagtgtagtgtaccaactagtatcatgtattcaaggttagacatttcgaatttttctcttgaaacgcattttataacacatacaaacgtacaattttttgcctgaattccactgtgtttgaagtaaagaacatgaaataaatcaatttaatttagaatgtatatctatagtctatagtatgggcactgaaacattttataaatatacgtacaccttcaaatagaagtgctaccaagacagtataccaacaaattgtcaacatact

SEQ ID NO: 9007 - DNA, 301 bp, Diabrotica virgifera
  Clone ID: pGUT543
ttttagtatattatagccttattagttaagaatatcggtgtaataatattgttgctagacaggtaaatgtcattttataccgggtgttacaatcatactgtgtttttttcttaaagttcggaacaccctgtggaatattctagcccatataaaatattaaaattaaaactcgattgtagacttaggctttcttaacattttcttttttgattcatttgcttatgttggaaaataaaaaagttacaaaaaagtgctttaacaactagccatgctttttatcaataaatcctcatagtatggg

SEQ ID NO: 9008 - DNA, 67 bp, Diabrotica virgifera
  Clone ID: pGUT545
agaaaggcaaccagagttcaaagaacatgttgggagcaaatgtctctaaacttccggatttcggttt

SEQ ID NO: 9009 - DNA, 227 bp, Diabrotica virgifera
  unsure (1)..(227): unsure at all n locations
  Clone ID: pGUT546
gtcatgggctgatattttattcgtttgtgtatatgaagcattagtcaatcttgcaggtaaggaggctgtancttcttaccctagtttacagcaagttaagaagattgttctagcaacaaaaggtattaataaatggattaaaaatagaccagcagtggaaggatacgatttgaaacaagatctgtaagatttttttatatatgtgtatttaataaataattattatt

SEQ ID NO: 9010 - DNA, 167 bp, Diabrotica virgifera
  Clone ID: pGUT551
gaactcttaccctaaattgtaaatgatttaatgcgaatgaaacaccaaatagaattcataaataaagataaatcaacaactagccaagcaaaaagaactcactgggatgctcgacaaaataaactaaactatgtcaatccgcgggggggggggggtctcggcccccc

SEQ ID NO: 9011 - DNA, 389 bp, Diabrotica virgifera
  unsure (1)..(389): unsure at all n locations
  Clone ID: pGUT557
gtctcgagttttttttttttttttttcgtttccccttagtacaaaaactcgacaagaatgtgcagattgcgcggcaatcccagatcacattggaaatttggcaacatcgatgttggatacgtttccataacgtggccaacctttcanaatataatatcatactccgactgattccaggaaactacagttccacaacaagtaaataataaacatntttatagacagttataataaaagaaaaatgttgcccattattgttgtaacagcttctaatgcctttgtttaccataccgagcagactcaaatcaagcaaacgcaaaaatattttaattatttggactataaagtaatattactgtaaactttcgcctgaattttgttgaattgtc

SEQ ID NO: 9012 - DNA, 311 bp, Diabrotica virgifera
  Clone ID: pGUT565
ggaaagtcgagtggcaacatgtggaggtttttgtgtctagtgttcgttattttcagagtgggatctgcagatttgggtccttgcgtccaccaggtgacttcaccagtaggccatgcagaaggacctcactgggatgctcgacgaaatatactatactttgtcaatattccagatggagaagtgtatgcctaccactataattcaaaaatattaaagaagattacacttagtggaactgcatcaccagttgtgccttctcgaaaagatcccaatctcttaatcgtgggtgtaaatagatctgtggtggcagt

SEQ ID NO: 9013 - DNA, 197 bp, Diabrotica virgifera
  Clone ID: pGUT566
ctctctctctctcactctctctctctctctctctctgctctctctctctctctctctcacactgggatcagccatcgggtccgtcgtcgcgtgatgacttcagcattatgggggggtcatcgactgcactgggaggatcgagaatcttttcatgggacagtggccatcctttaacgagatctgtaatcggatcaccc

SEQ ID NO: 9014 - DNA, 330 bp, Diabrotica virgifera
  Clone ID: pGUT567
catgccctgacacgtgtttctgggtttactcgttaacaaagaggctttacaagaagactgaattgaatcaaatcacacctactcgttggttttatttaaatattgttctgaagctattttcttgtggcatttctgcaattaactactttttatgggaaataagccacaattttactaaataaacgattttattaacgtttcttctaataatttatttaatctgactcatttatatcggcaattcagatatatattatacattgtaaagtagaagattttaaaatgatattgccaatatatatgagttgctttcctgggacgactctactg

SEQ ID NO: 9015 - DNA, 246 bp, Diabrotica virgifera
  Clone ID: pGUT570
ggcacgtagcgagtgtttattctttttatttatgttattaaggtttatttattcgtggaacgtacaatatcaacactagtgataaccaactgttgtgtgaccaggacagtccgaatcctcaatcttgacacaccctcttttagatgcgctccagtagagttcttctggacattggataggtccctcccaccggttactttcacaaatatacagataatgacagctatgaacatcagctttcatatc

SEQ ID NO: 9016 - DNA, 158 bp, Diabrotica virgifera
  Clone ID: pGUT571
gacaaccctactttgaatcaaataatcaggttaaataagaaggtattttcctttgtaacgataaaatacaattaaatggtaataattaatatttaccgccaaaacaacatatttcaagtcaccatggaatatactaaaaatagaacatcacattccca

SEQ ID NO: 9017 - DNA, 274 bp, Diabrotica virgifera
  unsure (1)..(274): unsure at all n locations
  Clone ID: pGUT573
gcgcacctttgctcgaagatctaactgaaatccataagcaagcaagagacgccgccgaagaaattgacaattgtgaaggagataatgcagctggtttgctctgcgtttttcaggtcgccatggatattcttaaagttgaccttcagattcccgaanctgtganaggtgatatccaacccgtcattgatgccggtaaagcccttcgtacagcagggcaaaagtgcatccacgatcaagttaccgccttctatgctaacactgggaaaacttttgg

SEQ ID NO: 9018 - DNA, 166 bp, Diabrotica virgifera
  unsure (1)..(166): unsure at all n locations
  Clone ID: pGUT577
attcggcacgagaggttacatcagagtagcccgtggtcacaacttgtgtggtattaacctcatgaactcttaccctaaattgtaaatgatttaatgtaaatgaaacaccaaatagaattcaaaattaaagataaataaacaactannaaaaaaaataaaaaaataa

SEQ ID NO: 9019 - DNA, 233 bp, Diabrotica virgifera
  Clone ID: pGUT583
cgcaattccaacttctaggctcgcgtctctttggcatctcggtacgaactactctccgtatcatttcctccagaggttcatcgttgtgttcgtcactttcttcaatggttcttactctatagcttcgtgaagtttgactagccgtgtcgtgctccaatgcaatagcaagtgcttcatctaaaatttcggtcttgctagtcgtaagggtttctgtagtacactctctttcaacc

SEQ ID NO: 9020 - DNA, 229 bp, Diabrotica virgifera
  Clone ID: pGUT590
gagagagagaactagtctctctctttaacaaatgcttcgatccatcatgtccactaaatgataattcctgacaacttaaaaaaattacaatatcaattaaacgacgtataacggcgtgattatttttgacaatttctaccgatgcgatctggcgatgccaaatgaaacaccgaccggcagatttaaatatgccgtacctgcctacggagagaatgtatgttcgcttgct

SEQ ID NO: 9021 - DNA, 236 bp, Diabrotica virgifera
  unsure (1)..(236): unsure at all n locations
  Clone ID: pGUT594
ctggagcggggctctttgttctcttggcgtatagtgcgaattgattgcgagcgcagagcaaaccaaatttctgcaggttcgcgtcttatctaactttactacgcttttgggtgaacaaggagttcacctttaccacataaatcatccaaaccgtgaacgtccacgttcgtgaagctgggaattttcttgcactgagtaaaggttttgggcactatttatagcccactcagtnactc

SEQ ID NO: 9022 - DNA, 227 bp, Diabrotica virgifera
  Clone ID: pGUT602
agagagagagagagaactagtctcgagtttatttttttttttttttttttatttttttttttatttttcttttaacctaaaaaatttttttttaggttccaaaccaagtttaacctaccacctattaattctatccaaataaaccaaaccccttttctcctcctcctaatcacatatccccctcctttcctccctcctgggccccttcctttcctccacaacttgaa

SEQ ID NO: 9023 - DNA, 194 bp, Diabrotica virgifera
  Clone ID: pGUT608
atacaatcaaacgcaaacgtcgtgtgattgtgaaggaaaacattttcagatttaattatttatttccacttttaatcaaagtatttcggaaaaactgtaatatatttgagattaaaatggcaggaataaaagcattggttaccttagcctttcttggttctattggtatgacgtttgtgattttggcatgtgct

SEQ ID NO: 9024 - DNA, 248 bp, Diabrotica virgifera
  Clone ID: pGUT610
ttctcctcgactccggtgagagggcccagtaagtggtcttggtccctgaaattgttaggggagcacgaccaatgaatccaggcacggtcccagcgtccatcgactgtgctccgggtggtcaccggataccgccgctggactctcaaaagtgccgcaactgaggcgatcaagtgcggcacctgcgcctacaacatgtagacatttcgttccaacttccttgcggctacccttacccatcaatgtaatct

SEQ ID NO: 9025 - DNA, 330 bp, Diabrotica virgifera
  unsure (1)..(330): unsure at all n locations
  Clone ID: pGUT613
catgccctgacacgtgtttctgggtttactcgttaacaaagaggctttacaagaagactgaattgaatcaaatcacacctactcgttggttttatttaaatattgttctgaagctattttcttgtggcatttttgcaattaactagtttttatgggaaataagccacaattttactaaataaacgattttattaacgtttcttctaataatttatttaatctgactcatttatatcggcaattcagacatatattatacatttttaagtagaagactttanaatgatattgccnnatattatgagttgctttcctgggacgactctactg

SEQ ID NO: 9026 - DNA, 262 bp, Diabrotica virgifera
  unsure (1)..(262): unsure at all n locations
  Clone ID: pGUT614
aaaaagccgccttgctttgtgttgaaatatttctgtagacgatttatcccatatacctattgtgatgtttatatgatacaattctccaaaaacgatcgaatcaaaagcaaacaaattttttgaaattagtacattttataaacattggatgtattatatttatactagagacatgtcatgtaagaattgtnttatgaacgtttttgttacattaaataaaatatattttttcagtanaaagttagtttnttatgaaaatatg

SEQ ID NO: 9027 - DNA, 85 bp, Diabrotica virgifera
  Clone ID: pGUT621
gtctggatcatcaacaactttaacatcacttgagctgacttctttggtagctaaaacagctacaaagacagctgccaaaagaaag

SEQ ID NO: 9028 - DNA, 302 bp, Diabrotica virgifera
  unsure (1)..(302): unsure at all n locations
  Clone ID: pGUT622
gaacaatggtcaaaagattgtctcacaacaaacatctgatgattgggaacaacaaaaccaacaattcggtggaagtgacagctacgttaaaactacaaagactgttgttcattcttcgatacctgaccacagccacattcacaaacaaaccacacataactcccattcccactcctcgatagaagagactgacgtcaacttgattatcgaaagacaagaaggtganatcactcacttaagaacagtccttgccaacgctcatgtcgctctggatgctcatgagcatagaaatgatgacttag

SEQ ID NO: 9029 - DNA, 252 bp, Diabrotica virgifera
  unsure (1)..(252): unsure at all n locations
  Clone ID: pGUT624
ctacactattatgacagctcttagcaaaccaaatacatttgttggagattttcttcaagaaaaacttaatacagattggtggctcaacggaaaaatatggaaattagtacaatggtgtgaggataacgagtacatataaatattgattgattttactaacagtaatatatatntttttgtgtacaatgtacaaattaatgatctatgttataatttataatgtttacattcaataaattatgtatcaatatc

SEQ ID NO: 9030 - DNA, 76 bp, Diabrotica virgifera
  Clone ID: pGUT627
tctctctctctctctctctctctctctctctctctctctctctctctctctctctctctctcgctcactctatgtc

SEQ ID NO: 9031 - DNA, 326 bp, Diabrotica virgifera
  unsure (1)..(326): unsure at all n locations
  Clone ID: pGUT634
ctcttattcaaaatttataataccaaaatatttgaagaatttgacggtactatattgatctttcacaaccagcatcttctggccaatcacaaacatttagtgaaggattgaagtgtaaacctcctgaacagttgtaaaggtatggtgctccattcgaacattgacagaatttggtacaatctggaagtgctgcatatactgggaacttgccatcaactgctgggcaaacaacattattttgcaaacactcttccgatccaactggtaattcgttgcggctttcttcacttgttgaactactttgaactgtngtgtcttctnctgta

SEQ ID NO: 9032 - DNA, 256 bp, Diabrotica virgifera
  unsure (1)..(256): unsure at all n locations
  Clone ID: pGUT641
aaggaactatgcttaccacgtttgtcttgtccagaagttcctgtagcttttaaatttttttgtaggtattcagttttggccttagttacaccatgtattgacatgaatactttaaaacacacattaatttcttgggaaactccattacgcttaactctaactttattggccgtgccgtntctaacatntcaagcttttgagctaaggttgtacaaaaggatcctgnaaaatacatgcaaagacaaagtcaccaatg

SEQ ID NO: 9033 - DNA, 173 bp, Diabrotica virgifera
  Clone ID: pGUT644
gcaccatagacagatgcaccctcaacagctgcaccatacacttatgcagcaccagcccttttttaagcaaaaaattaatttaaaaaataaccaagaatatattttcctccagctttgtaacgatagaatactataaaatcgtatccattatttactagaagaaaaataaaaag

SEQ ID NO: 9034 - DNA, 194 bp, Diabrotica virgifera
  unsure (1)..(194): unsure at all n locations
  Clone ID: pGUT646
atcattttgagttgtgcggatcgcaaatgtaccgttgttatatttggttaaatgtaactaaaatattctttaaacattgtatcatcatttcactgatggttaataaaaaacaaaaaaaaaaccgaaaaaaaaaaaaaaaaaaaaaaaaaaaaaaaaaaaaaaaaaaaaaaaaagaaaaaaaaaannnaacctcg

SEQ ID NO: 9035 - DNA, 293 bp, Diabrotica virgifera
  unsure (1)..(293): unsure at all n locations
  Clone ID: pGUT647
gtcaaacttccagaagcagatgcagacattactaaaaattttacctctgctggttggccttatgcggctattactatggaaaaccaaaacatcctacaattacgaagtgtaccatttttagattataaaacttgctatgatcaagtagcagcctacgtagcccttggtcgtactgaacctctcgatgaagcttgggataatatctacctaaacgaaacacaaaacatctgcacaggaacaaaagatgcggaaactgccgtntttacaanaggttaccatggaaggcccttggt

SEQ ID NO: 9036 - DNA, 296 bp, Diabrotica virgifera
  Clone ID: pGUT657
gttgccgactcccgtatcaactcctgtcccattcagtggtatgttcttgccgatcgggatatctccgctacccatatctgttatgatcatgatgacgaggatgtctctgactaccccacctactggcacaatttatacgtcgctggctactactacaccaccgtctggcaccttttccttatcctgcgctactacggagcctccgtcatagacctgatccttccacaatggactggaagaatctgcgcactaaccgtccacactgtcttatcgactggacccatcgtcgaccgttt

SEQ ID NO: 9037 - DNA, 305 bp, Diabrotica virgifera
  unsure (1)..(305): unsure at all n locations
  Clone ID: pGUT659
gtctcgactaatctttgcttatggcattgccgtggttgtatccctgccattggatctcattgaagatgagagtggataggagtatctagtagttccagtaagtatataaaggagagacttaacctggggtgccgaccaacatggatacagtcttggtcaaaagggaaatatctgggagaatggtgcgcacaaatttgacagtgcttacactggttcgagagcttgggattcccatggactganaccagattctcttggaggtcgtgtagaatacactagtaagccaactaaaactactgcttttg

SEQ ID NO: 9038 - DNA, 75 bp, Diabrotica virgifera
  Clone ID: pGUT660
ctctctctctctctctctctctctctctctctctctctctctctctctctctctctctctctctctctctctctc

SEQ ID NO: 9039 - DNA, 236 bp, Diabrotica virgifera
  Clone ID: pGUT661
taactgtatcgtctgtatatctgattgtatttatcagaatttcattaattttcgcgccccgttacgaattatgcagcgcttctttaaatattctatctgaatataaattgaacaacagtggggacagtacacaactctatctgacgcctgaaacctatttgggcttcgatacgttactaaaaacattttttggtaaaattgtggcttattcccattaaaaatagttgaattataaa

SEQ ID NO: 9040 - DNA, 164 bp, Diabrotica virgifera
  Clone ID: pGUT663
aaacgtcatcattttattattataggtacgacaatattttattgttcataatttcgtattaagaataagattagtatacagttgtgtctgagtttagcgaaccgactatagtagtccagtggtttacagactctataaaactaataaatggagatatctgacaa

SEQ ID NO: 9041 - DNA, 368 bp, Diabrotica virgifera
  unsure (1)..(368): unsure at all n locations
  Clone ID: pGUT665
acatataacataagcataaaatggcttctaaagcttcttttgtctccgtattgatgttgttggttgctgtagccaatgcttatgatgtaacaaattgtccttcaaataccggtcgccagagaaatcttgtttacgacaatcttttatcgggagtgtctatcaatgttcgtatgccaccggcaggatattttaatagacccataacgtgccttcaactaattgatcgacagggaacctctgtntctccaaagatagtggaaggcggatatctcgatacatacatggtagtcaatattacatcattanatggtcaagttacttattaccaggcacaaatatatattgattaataaatttctntaattgaa

SEQ ID NO: 9042 - DNA, 307 bp, Diabrotica virgifera
  unsure (1)..(307): unsure at all n locations
  Clone ID: pGUT669
ctcttattcaaaatttataataccaaaatatttgaagaatttgacggtactatattgatctttcacaaccagcatcttctggccaatcacaaacatttagtgaaggattgaagtgtanacctcctggacagttgtaaaggtatggtgctccattcgaacattgacagaatttggtacaatctggaagtgctgcatatactgggaacttgccatcaactgctgggcaaacaacattattttgcaaacactcttccgatccaactggtaattcgttgcggctttcttcacttgttgaactactttgaac

SEQ ID NO: 9043 - DNA, 192 bp, Diabrotica virgifera
  unsure (1)..(192): unsure at all n locations
  Clone ID: pGUT674
ctcctgtcctcttgagccctagcgatacccctcatgctccctctatagactggagaaatcaccgctctggactgccccnatcagttcacacctgtcccccctgtagtcagtgtctccgtccactgtcgagtggcatatgttcaatgggcactctctggttttggattgcttggacactcttatgggctcgct

SEQ ID NO: 9044 - DNA, 78 bp, Diabrotica virgifera
  Clone ID: pGUT679
aaaaaaaaaaaaaaaaaaaaaaaaaaaaaaaaaaaaaaaaaaaaaaaaaaaaaaaaaaaaaaaaaaaaaaaaaaaaaa

SEQ ID NO: 9045 - DNA, 176 bp, Diabrotica virgifera
  Clone ID: pGUT684
cctcagctgctgccccagccgctgcagctgcagcggctcctgccaaggaagacaagaaggagtctgaacctgaagagtctgatgatgatatgggtcttggactcttcgactagaaaagtacaagtgtttttttaagtacgtacatgacttgaggaatatagttattttttatttac

SEQ ID NO: 9046 - DNA, 275 bp, Diabrotica virgifera
  Clone ID: pGUT686
ttttgagctgctgtgcactctgttctatttgtgccagggttgagttcagttttttgatatttctgagtgtatttattctgggtccatgcttcttcctcacaagataacctctaacgactttctgcatgaatatcagttgtttgtgtctgtacttgattaagtttttcgctacaagagacgtatatgatacaattattgtggacatatggtgccaagtgtggggggcgagtatccatggatgagcttacatagagtctgacgtgatattctcataa

SEQ ID NO: 9047 - DNA, 318 bp, Diabrotica virgifera
  unsure (1)..(318): unsure at all n locations
  Clone ID: pGUT690
ggcacgaggaattacagagcaataactttatttaacaggtcatattatagcattctagaaaatatactacacaaagacttaaatcatgcactgaacgaatattaggaaaataccagaacatgttcagaccgggggaggtcgacgattaattccatacatacagtggagcacataagtcaagaatcgagagaatacgacagagaaatgcacctaatattcatggatggcaaaagcgcttgtgagactgccaatcggagaaanatgatggagcatctacagaatgttggaatcgcanataaattaagacatgtgctaaca

SEQ ID NO: 9048 - DNA, 254 bp, Diabrotica virgifera
  unsure (1)..(254): unsure at all n locations
  Clone ID: pGUT694
ctcgtgccgctagtctccagttttttttttttttttttttgattttcatgtattttattttataatataaaaaataatacatttattacttagcgtaaacttttacgtaataatccaaactatgtcctctaccagactctactttgacggtcacaaaagaatgaccaacacctccttcctttacagtagctgtagcaccttttgattcatcttgatcgggtggtgactgtaggcagtanatggttgctcgtngc

SEQ ID NO: 9049 - DNA, 250 bp, Diabrotica virgifera
  unsure (1)..(250): unsure at all n locations
  Clone ID: pGUT697
ctcgtgccgctactctccaatttctgttttattctttattgatttgcgtgtatttgattctataataaaataaataatccatttatcagataccgtatacgatcacctaataatccaaactacgtcctctaccagactctactttgacggtcacgacacaatgaccaacacctccttcattcacggtatctgtancaccttttgattcagcacgatcggtggtagaatgtaggcgatanatcgttgctcg

SEQ ID NO: 9050 - DNA, 330 bp, Diabrotica virgifera
  Clone ID: pGUT699
acgaacgactttttttttttttttttttatgtaaacccaaattgtatctttttttatattgtatctaatacattacttatgtaatttctttgttttgggcatagtagggacttgtccctctgcccttgtttatgtataataataataattacctattatttattcctaaaacccaatatcataaataagtaaactggtgcagtacggaaaacgtctaggtaccgtcaatttttgagattattgatgaataccactaaacgaaatgggatatacacatatttcacagaatgctcactattttattctataaataactaatcgtaaaatttg

SEQ ID NO: 9051 - DNA, 161 bp, Diabrotica virgifera
  Clone ID: pGUT704
attaatacattagtatattaagttgttagtactagtacaaccagcacgaaatactgattattcttcctcttcttcagctgcacctccaccaacgctcttcgtggggaggttcttcctctaaactcgtccagaaagaccgcctcccggtggtgacttaaaaa

SEQ ID NO: 9052 - DNA, 291 bp, Diabrotica virgifera
  Clone ID: pGUT709
gttctctctacatagtttcccagtaccttttagagatgatacgtcgatgtttaattgtcgatccccgtaaagattttagtctcattcggtcacgatctcatgtacgtcccatatcgtgtaattataaagccatcttcgccgctgtatgcgtatctcgagtatcctgtctgtgttccgagactatcacatcatcgggcggactgagttgaagtcgatcagcagcggcatcagtatcatgatctgttgtggatcatgttctgcttgcagaacaatcagcactgttatctactc

SEQ ID NO: 9053 - DNA, 297 bp, Diabrotica virgifera
  unsure (1)..(297): unsure at all n locations
  Clone ID: pGUT716
caaccacaaagttgaaggaacatatatcaaacttcgtattcccgaagaaaactttcttgagaatcttattaactgttatcaaatcctggatttaacaggtagttcatgtaaaccgcaaattacagaaggaggatacagccataactttatggagttacttcttgaaaatgcaaaaggcgaaatgatgcaatacgaaattcaagtttatactactgtnccaactactgaaaacccaacaacaatgtggaatgttttgtaaattgtntaaacttaacaataaaaacataacaataatgt

SEQ ID NO: 9054 - DNA, 112 bp, Diabrotica virgifera
  unsure (1)..(112): unsure at all n locations
  Clone ID: pGUT721
cttggttggacaagagaatcattatcctctcttggggcaaaatatgcccttagtatattaaaaagtattctgttctaagcatatgatttaaaataaaaaaaggcatatatnc

SEQ ID NO: 9055 - DNA, 332 bp, Diabrotica virgifera
  unsure (1)..(332): unsure at all n locations
  Clone ID: pGUT724
ctcgtgccggcacgagcggcacgagcgacatcgaaccaaaatggcaaaaatcgtcctcttcttctgcgccatcattttggcttcagcagctgctttaccaacccaatcagctgacggaggtgttgtcgacatcatcaaaaaggtcgtgcacaagcttgaagacataatggaaaaggtttttactgaaggtcncaatttcatcgacactttctctgacaagtatgacgaccaccttgctaaagtgctaaatgttacaaagaccgtgcttactaaaatcgctcaagcacttaaagttgttatagataaagttgctgatcaaagtgatgatgctg

SEQ ID NO: 9056 - DNA, 383 bp, Diabrotica virgifera
  unsure (1)..(383): unsure at all n locations
  Clone ID: pGUT725
ccgagagccaagcaccaggcttaagagttgaggatgttcttgtctcaagcccgttgcctcgctttacgtctcacagtgccagtgccacatcagaatgtacccataaacagaagcggaggtaaactagtgcccccatccgccatcttgttagcaggtttaggagtaggagtgtcatccttcagccgcaagcagatgcttcagtccaaacgtccaaaattgctatgaacctctcttanacattgacttgtcagttgtgtgacaatgttatcataaatttttgttacatgtagtgagtacgttctcaatgatgtgtggctaatctnnttatcaaaattgataatggtgaaatntatacagattccgatactagcgtataaacgata

SEQ ID NO: 9057 - DNA, 379 bp, Diabrotica virgifera
  unsure (1)..(379): unsure at all n locations
  Clone ID: pGUT728
ccggtataaaaccggagacgattattaatttgtggttcatctgggagaaagtgtacaaatttatttgaaaagtttcaacgaagctccagttggtcgtgtggttacgagtagattatttaaatatatcagctaaattcaaacatacggctagagtactattttttatatgggtagcaattatttggctgttaatagattatgtataaaactgtaataaagtagttcttgcaacctgtaaatctttatattatttttcttttagaaaaaattaataattagctaaatattattaggaaaaaaattttgttgttgactttttcacacttttaanaaattatttattgtttagaataatttatatntaatatntttttaatag

SEQ ID NO: 9058 - DNA, 139 bp, Diabrotica virgifera
  Clone ID: pGUT731
aatgggtccgtatgaggacaggaaacacaatcagatacaatgccaagaggcgtcactggcgtaaaaccaagctaaagttgtaaattgtttttatattcaattgacctttatttactttagttaataaacattattccat

SEQ ID NO: 9059 - DNA, 224 bp, Diabrotica virgifera
  Clone ID: pGUT740
aactagttcgagttttttttttttttttttttttttatatcccccatcttggggcaagaactgcctatgttatatgagtgatcttgtgatttattacacgttcagcataagacttaatgagctttaattttaagaagtgtaagttgaatactctgtttcatatttattttacctttgtaatataataaataaaaaaaaaaaaaaaaaaaaaaactcgagactag

SEQ ID NO: 9060 - DNA, 384 bp, Diabrotica virgifera
  unsure (1)..(384): unsure at all n locations
  Clone ID: pGUT744
cttttacataacaaaatgaaacaatttttagtgcttttggctttggcttgtgccgttgtggcaatgccatcaattgagtatcttaattcaaatgaatttgcacaacagtttgaaacggaggagcaactaagagattttataggcgatattatcaacagcactctaaatggggccatttctaagatgtctgatcccatgacaattgctgatatacacatggaccaaaactctgaggctctanccggaaccattgatattaaagacattgctatctctggtatacataagatagtatccactgccgtatcaaccaatctcatcacgcaacaactgaacatatcagttttggttcctgatcttactatcaacttcggagctgccgtc

SEQ ID NO: 9061 - DNA, 301 bp, Diabrotica virgifera
  unsure (1)..(301): unsure at all n locations
  Clone ID: pGUT748
cccaagtactggtaggcaggtgacagtaggagtagctggaaatgtgaaactagtcggctctcaaggttcccagattgacattcgtagaagtccttacaacccaagaactgtcgacgtcaccctcagaagtccaaatgctccaaccagaactctgcaaattgatgaagccaggaacggccaacaacttggttattccaacctccaaggtgtcaacaaccaaggtgtcaaccangctgatgttcttgctgatcttttcagtcaatatgagggtattgtanatgaccaaaccttttacagtttg

SEQ ID NO: 9062 - DNA, 343 bp, Diabrotica virgifera
  unsure (1)..(343): unsure at all n locations
  Clone ID: pGUT758
aaattatttttgaattgctggtttaatttacgacaaaaaaccttttttgcctttttttcatacgcgttttttatgcaaaaaaaattaaacatcttaacgtttacaaagtatttgaactaattttaactatttagaatgggaaataagccacaatattattaaaaaatgatttttattaacgtttcgacgcccaaatcgggtgccgttgtcaaaatacaaaatactattaacataaacaaaaatgttgttgcttagtanaaaaattcttctaataatntatttaatttgactcatttatatcgggttatattatttatatntgaactaagtttctatgcatatg

SEQ ID NO: 9063 - DNA, 332 bp, Diabrotica virgifera
  unsure (1)..(332): unsure at all n locations
  Clone ID: pGUT759
ggcactagtttgttatgtaaagccattttcttcttcaaaaccaaaatgtattcaactgtattcaaaatgttattattggttgcagtattaatattggttactatttcaccatccaatgcagataattataataaatgtcctgagaccagttatcaacgatccctggtttaccagaatgcattagagggggaatttatttatgtacgcattccacgcagaggtntctttaatgctccaatcaattgtcttctggtgaccgatattaatgaaagttttagtacaccagttatagaagatggtggatatgaaaatgagtatgtagttatacgtat

SEQ ID NO: 9064 - DNA, 201 bp, Diabrotica virgifera
  Clone ID: pGUT761
attcattggaaagttctacaccgaatttgactttggtaataatcgtgtaggattagcggaagcagtttaaatatacataataaataagtcatagaatgctctaaaaaaaaaaaaaaaaaaaaaaaaaaaactcaaggggggagggggggcccagttcgcggggggcgagtcgtaattcaattcaataggcatcggtttaca

SEQ ID NO: 9065 - DNA, 377 bp, Diabrotica virgifera
  unsure (1)..(377): unsure at all n locations
  Clone ID: pGUT762
gtaattttgtacaaataaaatgtgaaattatgaaaacaacttgtcgattttgtgttttattagaagtaatacgatcaaaaataacaaaaatcagtcaaggaacagtacacactatcgaacaaaacacttcacacctgtaatatataaaaaaagtctctttagttcactttacactatttttataactcatcgtgatcgccttcttctacttgtggcacatgttcttctgcatcatcatcctcatcatcatcatcgtcatcctctttcttttcatcttcactggtagattctctntcggctttgtcttgttcttctntaaccttctnttcaccgtcttgtttatctntaagaactgataatgctttcttggcataatc

SEQ ID NO: 9066 - DNA, 309 bp, Diabrotica virgifera
  unsure (1)..(309): unsure at all n locations
  Clone ID: pGUT765
gagagagagagagagagagagagagagagagagagagagagagagagagctttgcccttttagcctcagctggaaaagaccttgattatggcatggaagttttgagatgcgccaacaaagcaatgagaccaggagtacctgaattgggagttccacaacatgatcccttcgtcgcctttagtaagaacatatcatggcatggagacatcggtgttgctagcacctcaatcgacatcgacacattgagatggtatggtcttgccgactggaacgttactgctaagcanatcaatgatgacgctgataatg

SEQ ID NO: 9067 - DNA, 319 bp, Diabrotica virgifera
  unsure (1)..(319): unsure at all n locations
  Clone ID: pGUT768
cagccgggaatcttagagaaggagttgtgtctttagatactgtgctattccaaaaggttcatacagctacagaaggaattgagattttaacagtagtaaacggtgcaagaatagaatggaaattcgttaaaaactatcagttcccacaactttttgacacagaagcttatcatgttgctagggtcggttgggaatatgaaggaatggaatttaattcgactacatatcttggaactgtcaattttaacgatcaaccaaatataggaaaaatntntaatgctgcagttctttgggcagaaaaacacgttttatatttccc

SEQ ID NO: 9068 - DNA, 168 bp, Diabrotica virgifera
  Clone ID: pGUT771
attttactttcaattactagataacagtaaataaaacacaagtacatactaaaaaaataataatactagactacctattggaagaatataaacaatttaattttgcttgttgattattatttgttttttataattggtaggggagcccaagcggggatttttgcagtt

SEQ ID NO: 9069 - DNA, 254 bp, Diabrotica virgifera
  unsure (1)..(254): unsure at all n locations
  Clone ID: pGUT776
tatatagatgtaaaatatttaaatggctattaaaaaataacggtctgagataaaaaattgaaaatttaggattgtatgtatcttttgcttctacatctcataaaaatagtaaaaaacggtttttccaaaaactaaaaaaatatatcagggggggcaacaccccttatgacgtacgggtatgaaactccatattatcctattcccaaaccgctagaatatacatgtaaaatntcataaaaatctgttcagtcgtt

SEQ ID NO: 9070 - DNA, 162 bp, Diabrotica virgifera
  unsure (1)..(162): unsure at all n locations
  Clone ID: pGUT785
actataaaaatattttattaattttttggagcattttgtcataaatgatttaggctttgttaagggcatcacagtcgtctttaagggcagcatcgatagcatcgtggaatttcaaggcagcttgtctggtgactgtgttttggcangaagcttcaatgtgag

SEQ ID NO: 9071 - DNA, 202 bp, Diabrotica virgifera
  unsure (1)..(202): unsure at all n locations
  Clone ID: pGUT787
gaactagtctcgagtttgttgttctctttgccattagctgtaaataaaatattttacacaagatgaaatcagtattcgttattgtattcttcgcttgttttggtattatattatcagcaaaacttccaactccagcaccaagtccaacaccagaaccagatgacttagtctgtggagtatgtnttatgattgggaatatcat

SEQ ID NO: 9072 - DNA, 173 bp, Diabrotica virgifera
  Clone ID: pGUT793
ccaagcgaacccttcaggttcaattggtgactttaggtcggaaaagtcgagcacgggctcaacacataaattatttggctatagatgttgagttttaacggttgctgttgtaatgcaggtcaatgaactcagggtggcagtgatagctctagtaactacgatcagggctccgt

SEQ ID NO: 9073 - DNA, 168 bp, Diabrotica virgifera
  unsure (1)..(168): unsure at all n locations
  Clone ID: pGUT796
aaaacacgaaaatgtttggttttgtagtaactatttgtttgcttgtaatatctgcacagggacaaattcctgttgaaagatgtccagatgtaaaaggagtggaaaatntcgatggagaaacctatntgggtgattggatcgaacaagcaagatacccactttattgga

SEQ ID NO: 9074 - DNA, 196 bp, Diabrotica virgifera
  unsure (1)..(196): unsure at all n locations
  Clone ID: pGUT814
gaatgacaacttaggggcagaatgaaaggcaccgttgaagaaaaacaggcagtactgcctatatnnnataagaagaagaagaagaagaatanatatttataaaaaaaaagtttctcttaaaggagtaacacctttattagcctaagataagatataaggccaatcgacaccgagctgtttaattgataaaaattat

SEQ ID NO: 9075 - DNA, 152 bp, Diabrotica virgifera
  unsure (1)..(152): unsure at all n locations
  Clone ID: pGUT818
ttcagatttaaatgtgactctgttttacgaaggattgtgtccatattgccataattttatagtggatcaattataccctggatatcanaaattaggagacagctttaaattggatgtagtaccgtatggatgggagacttataaaaaactag

SEQ ID NO: 9076 - DNA, 135 bp, Diabrotica virgifera
  unsure (1)..(135): unsure at all n locations
  Clone ID: pGUT823
tgtcaaaaagaaggtgtcgtttgtccagcagtatatggacccgcttcagtttatntccctctcagcgattgtactaaattctgccaatgttccaacggtgtgccatatgatcatgcttgtcctgctggtcttcac

SEQ ID NO: 9077 - DNA, 153 bp, Diabrotica virgifera
  unsure (1)..(153): unsure at all n locations
  Clone ID: pGUT824
gttcgtccgtctaaagatctggtctactggcaaggatcgatcccaccgtaaaccgataatctcaacggaaataagggctcgtgcgacagtcgtancgaactacgattgcctagtaaagtcacattgttttgagcctttcgactctcggaactc

SEQ ID NO: 9078 - DNA, 131 bp, Diabrotica virgifera
  Clone ID: pGUT825
tcactaacgctctacttagggacgatagaccgaaaaagaccgaatctagaaagaaagttaacatccaacaactaacaccatgtctttcaaggaacatttggagatgataagccttaacgaatccccttcta

SEQ ID NO: 9079 - DNA, 297 bp, Diabrotica virgifera
  unsure (1)..(297): unsure at all n locations
  Clone ID: pGUT827
atacatnttatggttgtaagtatatttattatattattttattttcagaaaatacgtatntagttaaaaaattttccgacaattaatgttcagaaatcatttgtggcatttttaatgtgtttgtgtgtgtnttatttntttattattttaatttttggcactgttttaataaaaatgtttgagaagttntaaggtatagttatattaggcatagtaggtttaaattaattttattttttaattaaattttaattaaaagtttttttatttccggtttatatccttttaaccttttat

SEQ ID NO: 9080 - DNA, 231 bp, Diabrotica virgifera
  unsure (1)..(231): unsure at all n locations
  Clone ID: pGUT830
attggtgcaggaggtgtaggttctccatatgttgaaataagtatcaaaccaggattcttcgaatctcttcattataggattgaagtgtacaggaaagcacctgataccacgcctgcctcaacagcaacaactatttagttaatataaatacatattttttaaatatttttttaatggtccaataatttttgaaatngaanaaaaaaaaaaaaaaaactcgaagggggggcc

SEQ ID NO: 9081 - DNA, 198 bp, Diabrotica virgifera
  Clone ID: pGUT832
tcaaaatccaaaataagatataacagttaacatatatcatatgcaacaatattttgatcaaaatgtcacctttgttttgttcgatcgccgttagagtgtaatccgaacaagtgtgctttgtaaacacgctttatatcccacttatacaaattaaatgaattaagttaaggcatgtttctttaaatttaaaataataaa

SEQ ID NO: 9082 - DNA, 164 bp, Diabrotica virgifera
  Clone ID: pGUT840
gcgagggctggattgcagggtttattttgcaaaatctattgaacgcacacactggccaaaattcagatctatcctggagaacaaggtgtctctagacattccactaaaaaccaaagaggacatttttcttgctgtgtaattttcttgcataataaatgactgtc

SEQ ID NO: 9083 - DNA, 246 bp, Diabrotica virgifera
  unsure (1)..(246): unsure at all n locations
  Clone ID: pGUT842
ctcaaacttaaaagaaaaactactgtggaacaactcataattaatgatgatgaagcgagcaccagcggagatactggaactttacgaagtggggtgtgatgacaaatcgaagcgcagcaaaaaaatgttgatccggcaatatttggatgaatatttggattatggcttcatttggactggggaagaaaactgtccaattcccaagtgttttgtntgtgggcagacactcgctaatagcgcaatggc

SEQ ID NO: 9084 - DNA, 86 bp, Diabrotica virgifera
  Clone ID: pGUT843
aaaaaatcggcagataagatgattttgatactgttcgcgttttcagcgatactattcaacggtgtacattccgtatgtcttaaaaa

SEQ ID NO: 9085 - DNA, 135 bp, Diabrotica virgifera
  Clone ID: pGUT845
ttcgcgccaattccggatgagtgtacccaagacatggttcaactcagtagagccatcgtctgagtaaatcacagctgtttcccagatatgcctatcttattcccaaattcccccgtcccttttttgtgttccccc

SEQ ID NO: 9086 - DNA, 150 bp, Diabrotica virgifera
  unsure (1)..(150): unsure at all n locations
  Clone ID: pGUT852
tgttacgtcaaagatttctatagaagacatcaaaagtgacttaaagctctccatattaactgacagattacaacgaagaacgaatttcaaagaacgggaagttnaatttatgctccctccaaagagatttaaggaacaactccaatgttt

SEQ ID NO: 9087 - DNA, 130 bp, Diabrotica virgifera
  Clone ID: pGUT853
ctcgtgccgctcgagttttttgaacaaattcggggacaaatttagttttctaaaatggcacatacatataaacttatatattttgacgttcccggaaagggtgaagcaattaaaatgatcttaagctatg

SEQ ID NO: 9088 - DNA, 123 bp, Diabrotica virgifera
  unsure (1)..(123): unsure at all n locations
  Clone ID: pGUT854
ggcacaaagaagctctntctatacttttgttcttctccttctaataataaattacctccccctaaccttggaaattacggacattcgttaattgttcaaagtccttaacccatccgaaaaatt

SEQ ID NO: 9089 - DNA, 150 bp, Diabrotica virgifera
  Clone ID: pGUT855
tgattactgcgcgactggtgccgatttcggctcgagacaaaatgacccactcttaacgttaccgccgaagaaccaaggattcttttgccccccagttttaatttcgttgttttggtcctccttccccttctttgaaaattcacctagttg

SEQ ID NO: 9090 - DNA, 142 bp, Diabrotica virgifera
  Clone ID: pGUT859
gcaggttgtctcctaagttctactttaatgttcttttctttagcttccttacgttgcttttccttggattttactccttgccagaagtcctgaacaaccctggaattgtttacatgttccataccgaaaatgaatcctttgg

SEQ ID NO: 9091 - DNA, 74 bp, Diabrotica virgifera
  Clone ID: pGUT881
ctaagcccttatccaccacacttactcgaatccgaaaagaacgaacatccacttaatccaaatgcctttccaac

SEQ ID NO: 9092 - DNA, 77 bp, Diabrotica virgifera
  Clone ID: pGUT888
ctataattttaatccattttcaacaactcttaattcatatactaactattttccaagttggccttttatgccccccc

SEQ ID NO: 9093 - DNA, 197 bp, Diabrotica virgifera
  unsure (1)..(197): unsure at all n locations
  Clone ID: pGUT889
tcgagtnatttttttattttttttttttttttttttttttttttaaactttcatatatttattccgttaaaagttggttcataaatattaattattccaatttccataccctgaccttaaaaaccttccctcaataactatacccaacctaaccatatagtcctatatgttacctaaaatttactccccgcccgtgg

SEQ ID NO: 9094 - DNA, 76 bp, Diabrotica virgifera
  Clone ID: pGUT890
attaatttaatttttttagttgaataatatttatgttcaacctaattttaacaaaataaaaacctatcccttaaga

SEQ ID NO: 9095 - DNA, 129 bp, Diabrotica virgifera
  Clone ID: pGUT893
aaaatacgtgaaggccaaaatgggtagatcaactgcgaaggtgctaccgttattgttaaaaccaaccctacccccaaaatcctttcctccaaagttttcccaattccaaaatccctattttccaattgg

SEQ ID NO: 9096 - DNA, 127 bp, Diabrotica virgifera
  unsure (1)..(127): unsure at all n locations
  Clone ID: pGUT898
tgtctcgagtnttttttttttttttttaaaacaaaataaattttaatataaaattaaagattttgggtaccttttgaataaattttatgatgaatgttaattgtttttcccatttaattttcctcct

SEQ ID NO: 9097 - DNA, 114 bp, Diabrotica virgifera
  Clone ID: pGUT901
gaatcgcagctgcggtggttttttgaacaaattcggggaaaaatttaattttctaaaatggcacatacatataaacttatatattttgaactcccccgaaagggttaaaccatt

SEQ ID NO: 9098 - DNA, 144 bp, Diabrotica virgifera
  Clone ID: pGUT906
aaaacttgagatatggaattgggtgtaaaagtatctccaatttccacctctaatcttaaccttaataaaacctccatacctccagaattgtttgttaacctgtccactaatataataacacttattcctatgaatattttattc

SEQ ID NO: 9099 - DNA, 184 bp, Diabrotica virgifera
  Clone ID: pGUT907
gcacttatgaagaggacgtcgaatatatttatggagtaactgacctcagaacagtaactgaaatgtgcatagacatgaacaaatgttaagctaaaccaaatatctaattgtatttttttaataaaaacatgtttttattgttttatttaaaaaaaaaaaaaaaaaaaaaaaaactccagggggg

SEQ ID NO: 9100 - DNA, 308 bp, Diabrotica virgifera
  unsure (1)..(308): unsure at all n locations
  Clone ID: pGUT928
cagataccagttttttggctgttttactcatattcataaacaaaggattttccatggtttgaatggtgtgtgcatactttgcatacctcttttgtaatttaatgcagattcgttgctcacatctcgcataatttttggtaataaaaaaagttgttgaaaagctattgattactctcgtactccaaagacaaactgtgctcatatttctggcgatgtcatcgctccttatcgagtctggatactttgggattacctcccaatatttcgtattaagttatataccatacttctnatattatatctcatca

SEQ ID NO: 9101 - DNA, 387 bp, Diabrotica virgifera
  unsure (1)..(387): unsure at all n locations
  Clone ID: pGUT931
aacgattgtgtgctaatcttatatttcaaacgtaacatctcaaccggctcaatctcagtgtagattagtcggtctggaaaacaataaatccaaacaacaaaagcggtacaaatccgtgtcaagtattttatcaacaactgaacaatgtcactgcttgcaaacgctttcatctgtgctacagacattaacagcacaaattatgacgattcctatcaggaaatagttaaagatttagtgccagactgggtttgtgctctggaatatgttccctggtgctgggccaactttggatctctccttgtcggacttagcggggtnttgcctctccttgtcatacccattgatcattcggataaattgaaacaaggatatggtgccaataaactt

SEQ ID NO: 9102 - DNA, 294 bp, Diabrotica virgifera
  unsure (1)..(294): unsure at all n locations
  Clone ID: pGUT934
gtttcttttataccatatacagcgatggacatattatgtatcctgctttacattatactaggactccctctcttcgtatacctctaccaaaaatggaaatactcctattggaggaccacaaatgtcttccacttagaaaccaaatttccttacagcagtgcccaatcagagctcanacttaatggtgccatgaccacgatcgtcgaagatctttatcataaagtcaaatcgcgcggattagaatatggatgatactttgagttcctgacgcccatgttcgttcctgtcgacttg

SEQ ID NO: 9103 - DNA, 292 bp, Diabrotica virgifera
  Clone ID: pGUT936
atcgcatccaaaactgttctattcggactcttggtagtccttatggtcaaccactctttggctagacatctgactgtctgccccaactcatacaaagcaaccaaagctgtattcgacaaataagtatcaacatccgttgtatgaagcaccatccgtgtgagagtaccatatatcttgttcttgaagaaaccaatcacctgcattgttattgtggacaataaccaaagcgatagcgtcactgaagtataacatggtggtgttgatagtacatgggtgaccgtatacattgctc

SEQ ID NO: 9104 - DNA, 248 bp, Diabrotica virgifera
  Clone ID: pGUT943
ctagtctcgagttttttgattattctttttttttttctttttttttcttttttttttatgtttcatgtcaaattattcctttatttgtccaagtttaatttacagatcgcaaataatgcaaggcaagttataagtccattatttattaaaaatacattgatactccaatattattatttgatagatacaaaacatatccgaattatttaagtagtggaatccatatctcgtgacgaattcggctcaag

SEQ ID NO: 9105 - DNA, 281 bp, Diabrotica virgifera
  unsure (1)..(281): unsure at all n locations
  Clone ID: pGUT946
ttcgcttcgtacccagcttgcaaagaaatcaaaacagttatcgatgaacacaaaaataaacttccatccaagtcactcatctgctcaaccatgcncaaggtaaggaactgcgctaaagctcacattgaaagtaactgtcaaaacacaatcaccagacaagctgccttgaaattccacgatgccatcgatgctgcccttaaagacgactgtgatgcccttaacaaagcctanataatttatgacaaaatgctccanaaaattaataaaacatttttctagtt

SEQ ID NO: 9106 - DNA, 125 bp, Diabrotica virgifera
  Clone ID: pGUT953
tacgaattgctcataggggtgcattttttattaaaatgtcgagtactgtgatacaaaaatttaaaataatcaatcttatcgatttggtatctttatacctaaatagatatttaattaacaataat

SEQ ID NO: 9107 - DNA, 103 bp, Diabrotica virgifera
  Clone ID: pGUT955
tatataagaagtgttcggtacaagtttctcagtttttcctacacaattcaaaaatatagaataacaatgtctaactctgcatcaaatctagtgtgtgtcaacg

SEQ ID NO: 9108 - DNA, 73 bp, Diabrotica virgifera
  Clone ID: pGUT963
tctctctctctctctctctctctctctctctctctctctctctctctctctatctctctcgatgtctctctct

SEQ ID NO: 9109 - DNA, 326 bp, Diabrotica virgifera
  unsure (1)..(326): unsure at all n locations
  Clone ID: pGUT966
ctcaattgttgctcttgctcttaatacttttctaatacaccgtgcagactgataggcagtactgttccttctgccttctaccanaggcatgcataggcgacttattctcacagcataagcgttctatgtaaacaagaatatgcatngtaatgtagttttatacgtccaccatcacttttatggtattgcgcatgatttgaattttttaacaaagtatgatatataatatttatttaaatctaattattattttctcattttgggcctgcaatgccccgttagggctgatgcccctaggcaactgcctacttcacttataggttaat

SEQ ID NO: 9110 - DNA, 458 bp, Diabrotica virgifera
  unsure (1)..(458): unsure at all n locations
  Clone ID: pGUT978
aacataatcaataatatcagaaaagcttcatcaaacttaaatagaattgttgctaataaatcataatagttaaatgttaataaaaactttcaattggaaaccaaaaggaaataagattcccatgtgtaaatgttatgtttaagaataataagatatagcanatattaagcagtgattgccatttaaataaaataaacaatattttgattacaattgtaacccatatgtgttatnatttnacttttttctttcctatcccgattaggaaccattgagatatacttagaagccacgtatataagtaattaattttataaaaagccctgagattgaaaacatattgatatgtgatctggtanactaattagattattattaatgcattgattaaattacatgatctattaaaattttatctcatattcataatcgggatcacatctactgtcgtccaacgt

SEQ ID NO: 9111 - DNA, 202 bp, Diabrotica virgifera
  unsure (1)..(202): unsure at all n locations
  Clone ID: pGUT991
gtaccgtgctgtcattgttgacagttgtaaatcctccgaacatttttttataaagttgataatatattttgtggaattatgtataaataatattaaatgcggctaccactcccaannnanaataaaaactaaaaactaaaacaaaaactcaaaaaaaaacaaanaanatttgtaattatttttactaacaaaaaaacaatcc

SEQ ID NO: 9112 - DNA, 350 bp, Diabrotica virgifera
  Clone ID: pGUT992
gacctttgaaagatctggtactttgaatactatgaacctttaagtcgttgtctaattcggcgctaaaattgaccagctccttaaatatgcctctatttctgaattttctttttcgtcgtgacctcttaaagctaactcgaaagctccacaacaccttataacatttgtagttttttttctagcgaaaaaccaccaaaaaaatttgttaaaatactaatctttattgtcaattaataaatttaacataagagataatcaaaatatccacgatcatgatgcactaaaagtttaattataaatacaaaaactttttaacagaaaatatacataatataagcgacaaaccagca
